(12) United States Patent
Grandi et al.

(10) Patent No.: US 9,079,946 B2
(45) Date of Patent: Jul. 14, 2015

(54) **IMMUNOGENIC PROTEINS AND COMPOSITIONS FOR THE TREATMENT AND PREVENTION OF *STREPTOCOCCUS AGALACTIAE***

(75) Inventors: Guido Grandi, Segrate (MI) (IT); Domenico Maione, Siena (IT); Cira Daniela Rinaudo, Castelnuovo Berardenga (IT)

(73) Assignee: Novartis AG, Basel (CH)

( * ) Notice: Subject to any disclaimer, the term of this patent is extended or adjusted under 35 U.S.C. 154(b) by 152 days.

(21) Appl. No.: 13/637,929

(22) PCT Filed: Apr. 1, 2011

(86) PCT No.: PCT/IB2011/051415
§ 371 (c)(1),
(2), (4) Date: Nov. 29, 2012

(87) PCT Pub. No.: WO2011/121576
PCT Pub. Date: Oct. 6, 2011

(65) Prior Publication Data
US 2013/0071416 A1   Mar. 21, 2013

(30) Foreign Application Priority Data
Apr. 1, 2010   (GB) .................................. 1005625.7

(51) Int. Cl.
*A61K 39/09*   (2006.01)
*C07K 16/12*   (2006.01)
*C07K 14/315*  (2006.01)

(52) U.S. Cl.
CPC ........... *C07K 16/1275* (2013.01); *A61K 39/092* (2013.01); *C07K 14/315* (2013.01); *C07K 2317/734* (2013.01)

(58) Field of Classification Search
None
See application file for complete search history.

(56) References Cited

U.S. PATENT DOCUMENTS

2010/0150943 A1*   6/2010   Grandi et al. .............. 424/165.1

FOREIGN PATENT DOCUMENTS

WO   WO 2008/084072 A2   7/2008
WO   WO 2009/027768 A2   3/2009

OTHER PUBLICATIONS

Houghten et al. New Approaches to Immunization, Vaccines86, Cold Spring Harbor Laboratory, pp. 21-25, 1986.*
Skolnick et al. Trends in Biotechnology, 18: 34-39, 2000.*
Greenspan et al. Nature Biotechnology 17: 936-937, 1999.*
Margarit Y Ros, "Preventing bacterial infections with pilus-based vaccines: the group B streptococcus paradigm," Journal of Infectious diseases, Jan. 1, 2009, vol. 199, No. 1, pp. 108-115.
International Search Report mailed Oct. 19, 2011.

* cited by examiner

*Primary Examiner* — S. Devi
(74) *Attorney, Agent, or Firm* — Banner & Witcoff, Ltd.

(57) ABSTRACT

The invention provides proteins and compositions for the treatment and prevention of *Streptococcus agalactiae* (Group B *streptococcus*; GBS).

11 Claims, 20 Drawing Sheets

FIG. 1A

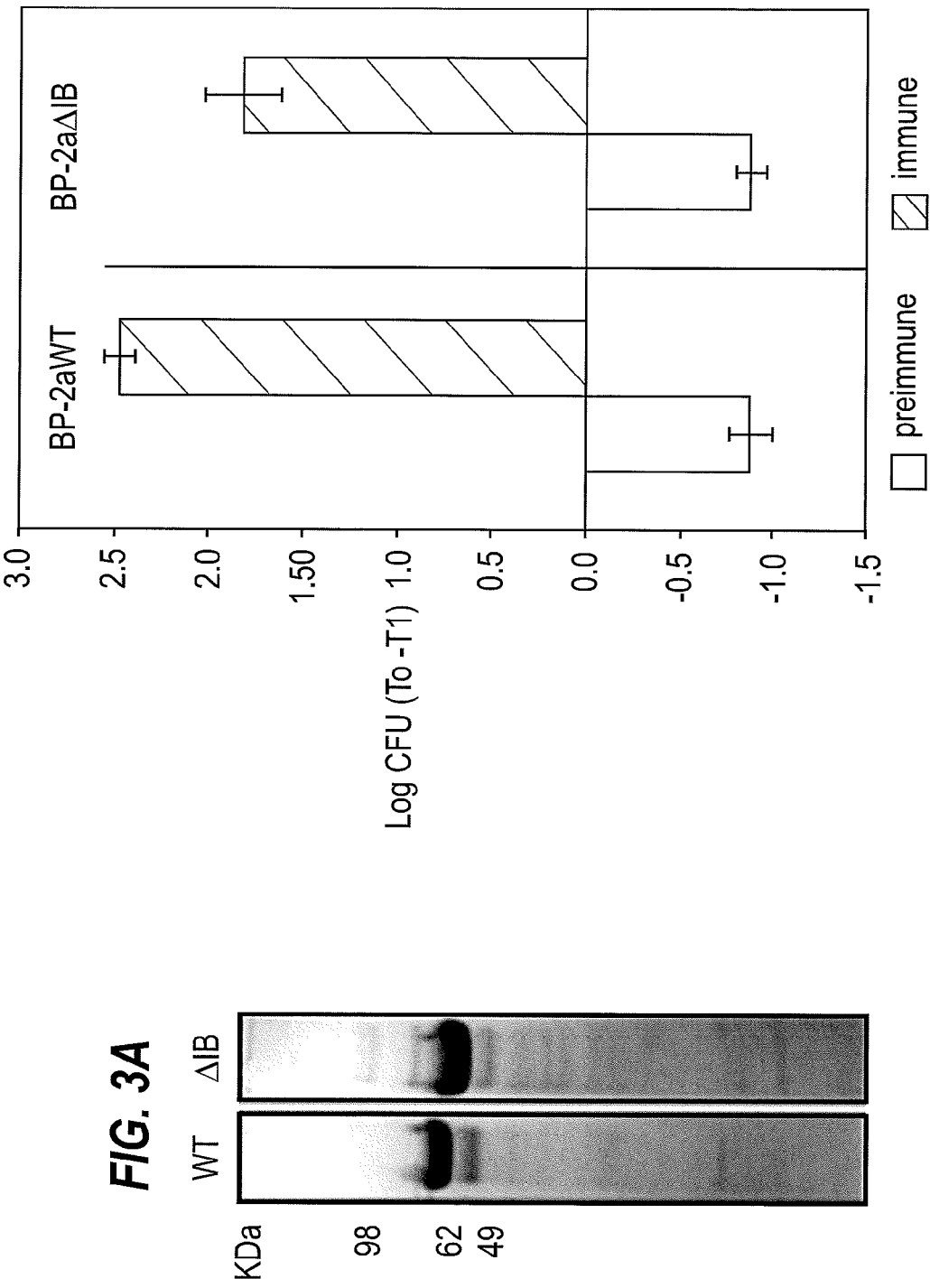

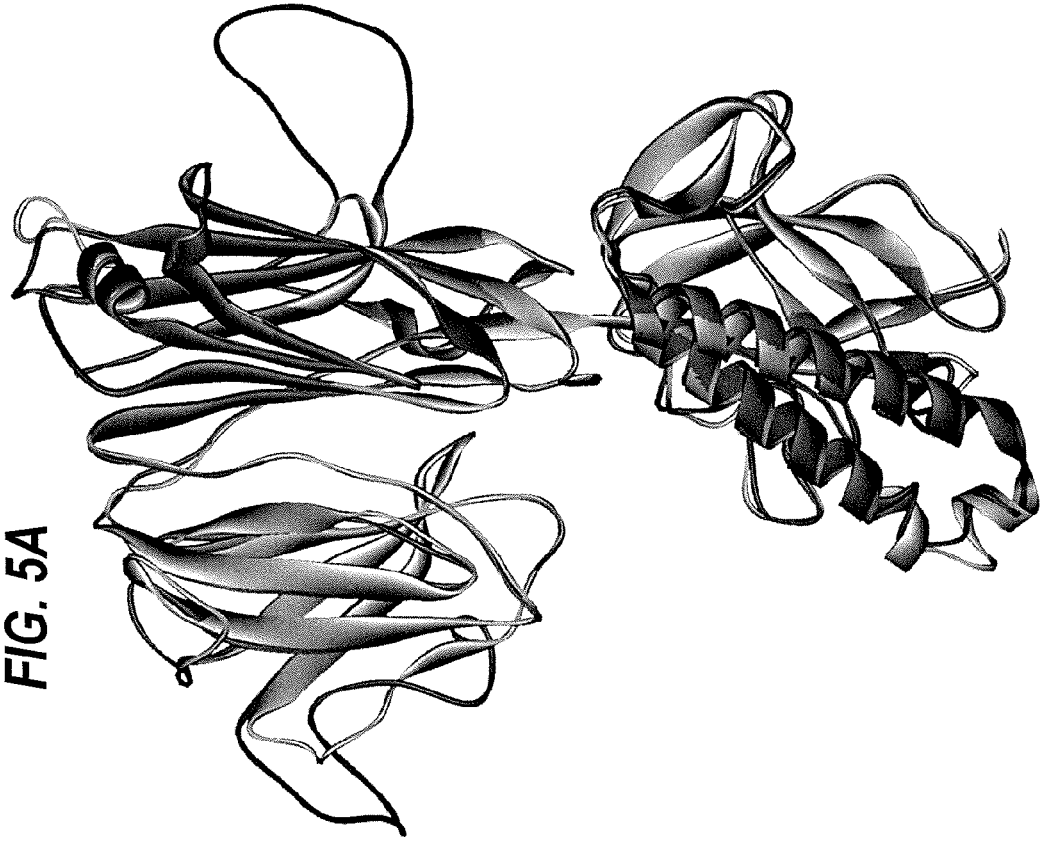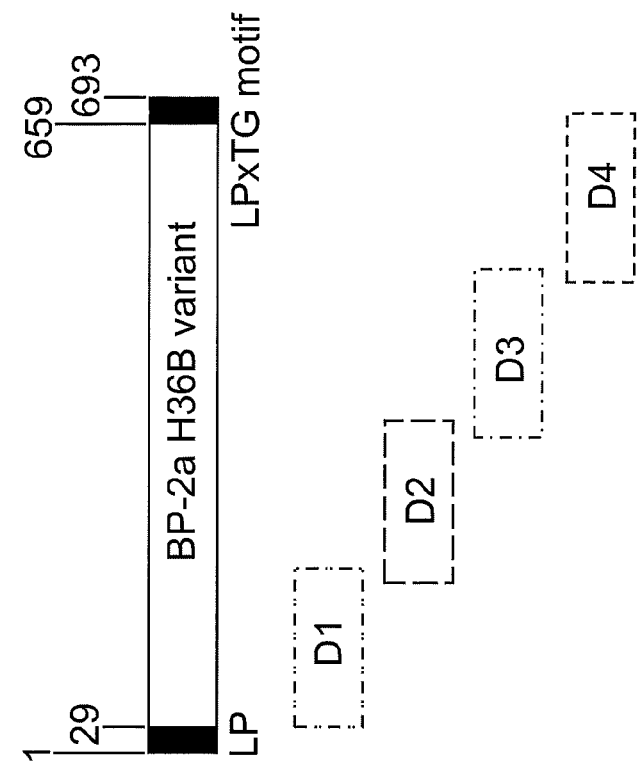
FIG. 5A
FIG. 5B

D3+Helices

FIG. 6A(ii)

```
D3and2H_515     GNNPTIENEPKEGIPVDKKITVNKTTWAVDGN----------EVNKADETVDAMFTLQVKDGD-
D3and2H_CJB111  GNNPTEESEPQEGTPANQEIKVIKDWAVDG-----------TITDANVAVKAIETLQEKQTDG-
D3and2H_DK21    GNNPTIENEPQTGNPVNKEITVRKTTWAVDGN----------EVNKGDEKVDAMFTLQVKDSD-
D3and2H_O90     GNKPGTDISEQPVTPEDGEVKVTKTTWAAGANKADAKVVYTIKNATKQVVASVALTAADEKG
D3and2H_H36B    GNKPGKKVKEIPVTPSNGEITVSKTTWDKGSDLENANVVYTILKDGGT-AVASVSLTKITPNG
D3and2H_2603    GNKPGKDITELPVTPSKGEVIVAKTWSDGIAPDGVNVVYTILKDKDK-TVASVSLTKTS-KG
                                                                        _____D3

D3and2H_515     KWVNVDSAKATAATSEKHTEFNIDNAKTYRVIERVSGYAPEYVSFVNGVVTIEKNNKDSNEPTPINPSEP
D3and2H_CJB111  TWVNVASHEATKPSREHTETGIDNAKTYRVVERVSGYTPEYVSFKNGVVTIEKNNKNSNDPTPINPSEP
D3and2H_DK21    KWVNVDSATATAATDEKYTFKNIDNAKTYRVVERVSGYAPAVSFVGGVVTIEKNNKNSNDPTPINPSEP
D3and2H_O90     TINLGNMTFEITGAESGTEKGIQN-KAYTVSERVAGYT-NAINVTGNAVAITNTPDSNPTPINPTQP
D3and2H_H36B    EINLGKGIKFTVTIGAEAGKESGITDSKTYMISERIAGYG-NTITTGAGSAAITNTPDSDNPTPINPTEP
D3and2H_2603    TIDLGNGIKFEVSGNESGKFTGIEN-KSYMISERVSGYG-SAINLENGKVTIINTKDSDNPTPINPTEP
                                                                                       _____D3
```

```
D3and2H_515     KVVTYGRKFVKTNKDGKERLAGATFLVKK-DGKYLARKSGVA
D3and2H_CJB111  KVVTYGRKFVKTNQANTERLAGATFLVKK-EGKYLARKAGAA
D3and2H_DK21    KVVTYGRKFVKTNQDGSERLAGATFLVKNSQSQYLARKSGVA
D3and2H_O90     KVFTHGKKFVKVGDAD-ARLAGAQFVVKNSAGKFLAIKEDAA
D3and2H_H36B    KVVTHGKKFVKTSSTETERLQGAQFVVKDSAGKYLALKSSAT
D3and2H_2603    KVFTHGKKFVKTNEQG-DRLAGAQFVVKNSAGKYLAIKADQS
```

```
D3and2H_515     TDAEKAAVDSTKSALDAAVKAYNDLTKEQEGQDGKSALATVSEKQKAYNDAFVKANYSYE
D3and2H_CJB111  TAEAKAAVKTAKLALDEAVKTAKLTKEQEGQEGKTALATVDQKQKAYNDAFVKANYSYE
D3and2H_DK21    TNEAHKAVTDAKVQLDEAVKAYNKLTKEQQESQDGKAALNLIDEKQTAYNEAFAKANYSYE
D3and2H_O90     VSGAQTELATAKTLDLDNAIKAYNGLTKAQEGADGTSAKELINTKQSAYDAAFIKARTAYT
D3and2H_H36B    ISAQTTAYTNAKTALDEAKIAAYNKLSADDQKGTKGFTAKAEIKTAQDAYNAAFIVARTAYE
D3and2H_2603    EG--QKTLAAKKIALDEAIAAYNKLSATDQKGFKGITAKELIKTKQADYDAAFIEARTAYE
```

FIG. 6A(iii)

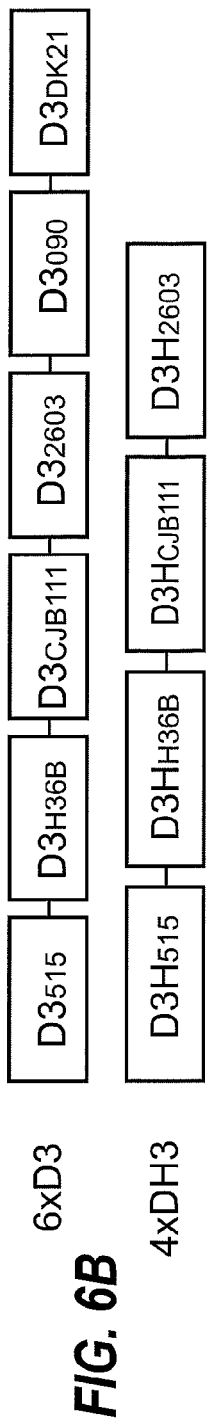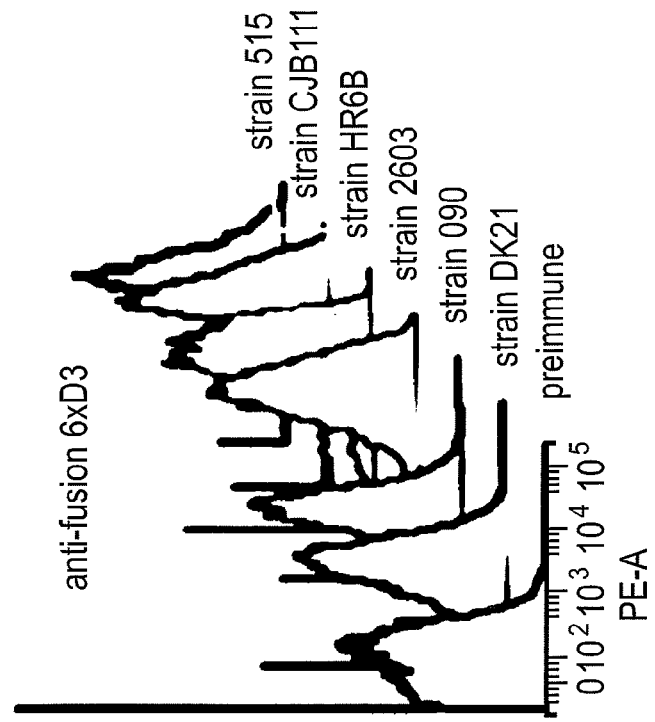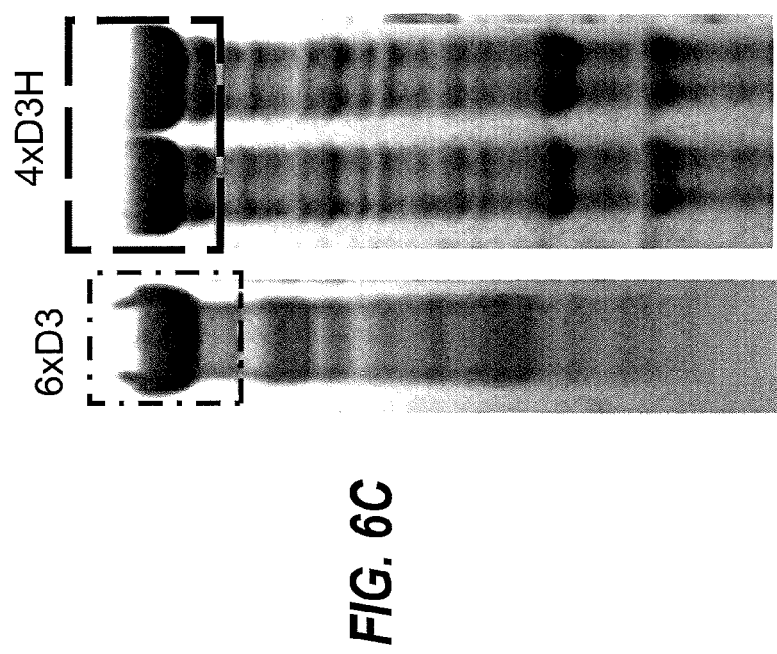
FIG. 6B
FIG. 6D
FIG. 6C

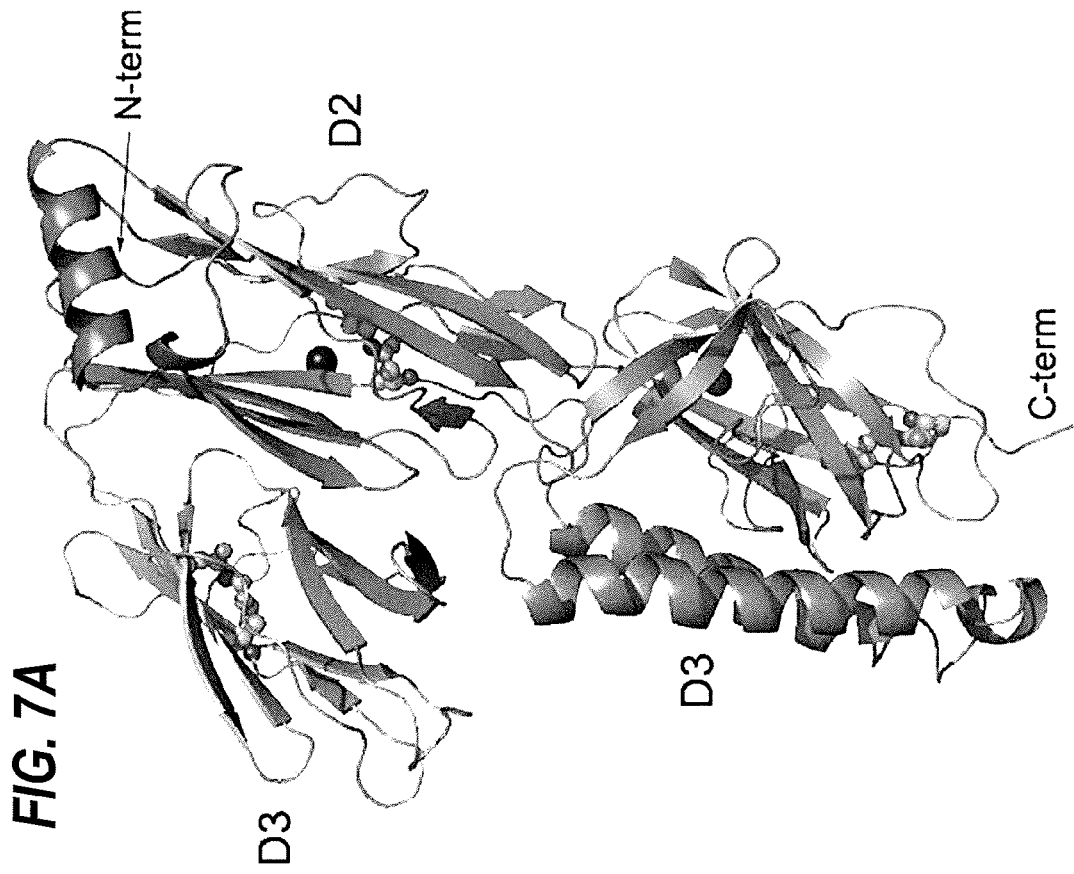
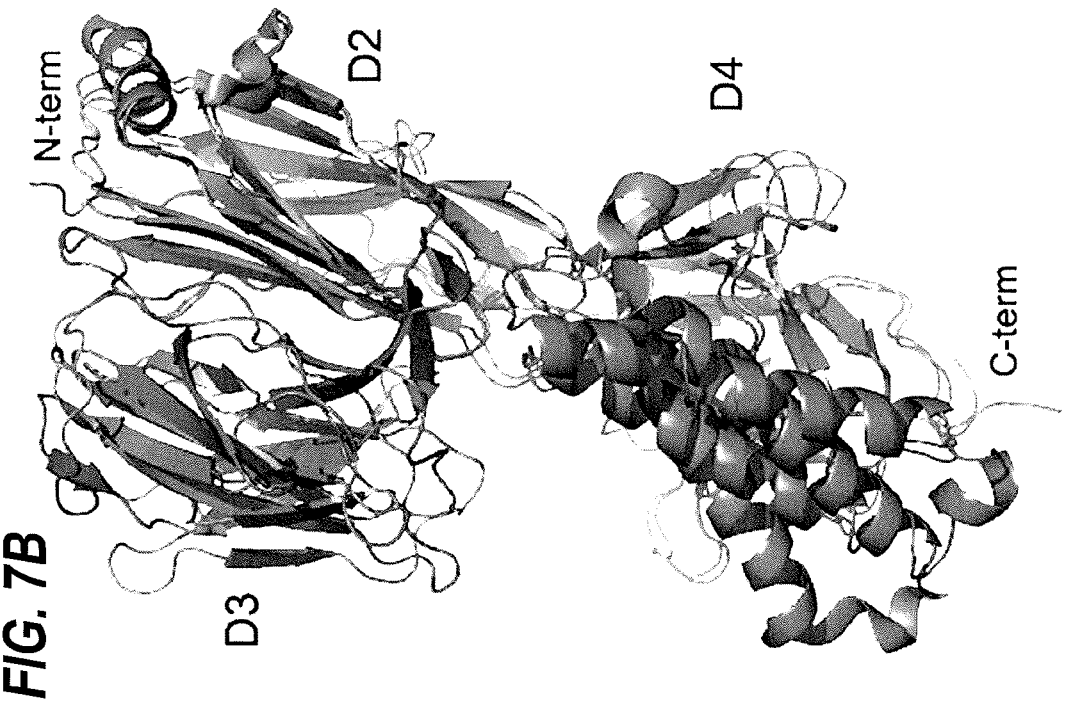
FIG. 7A
FIG. 7B

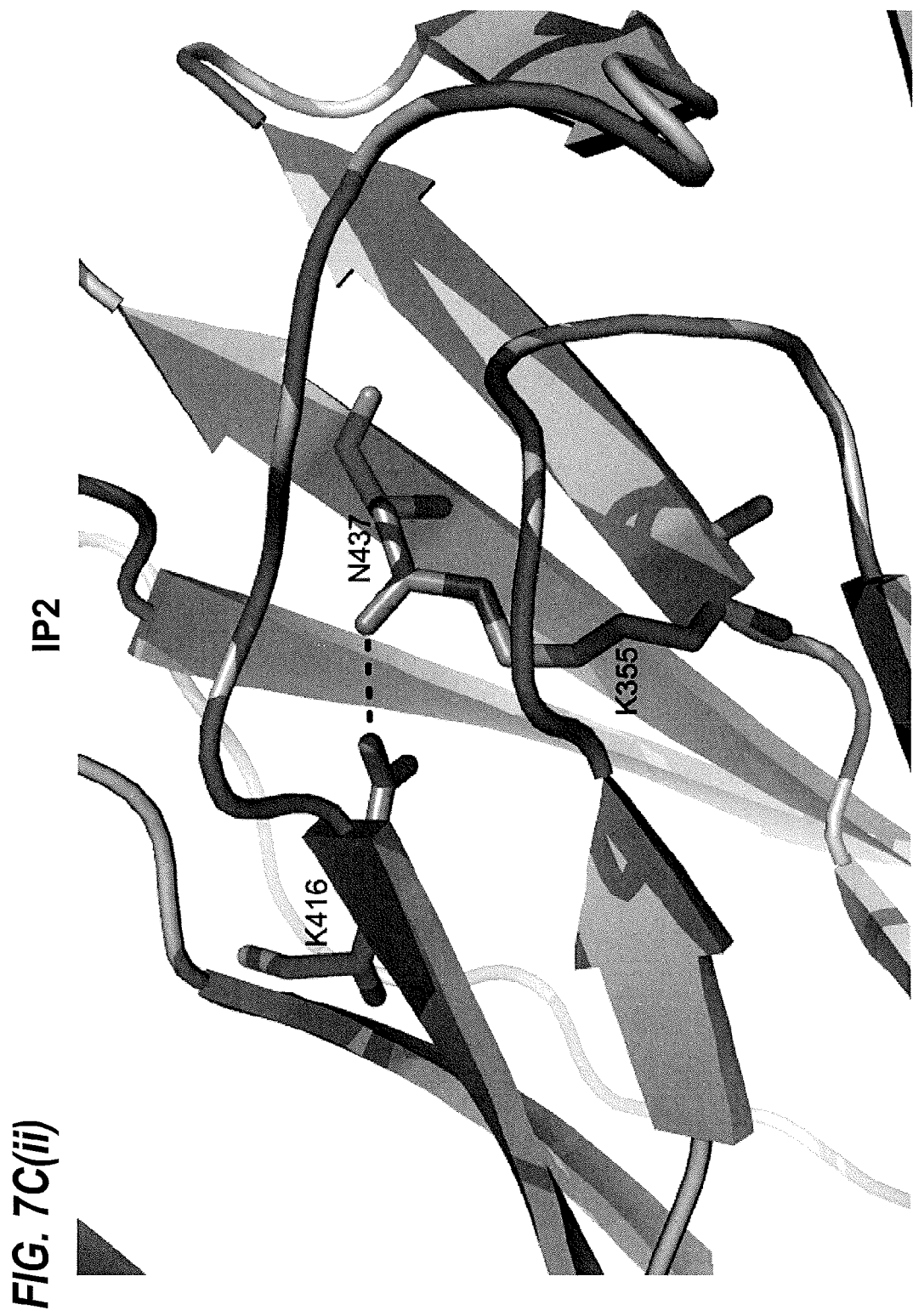
FIG. 7C(ii)

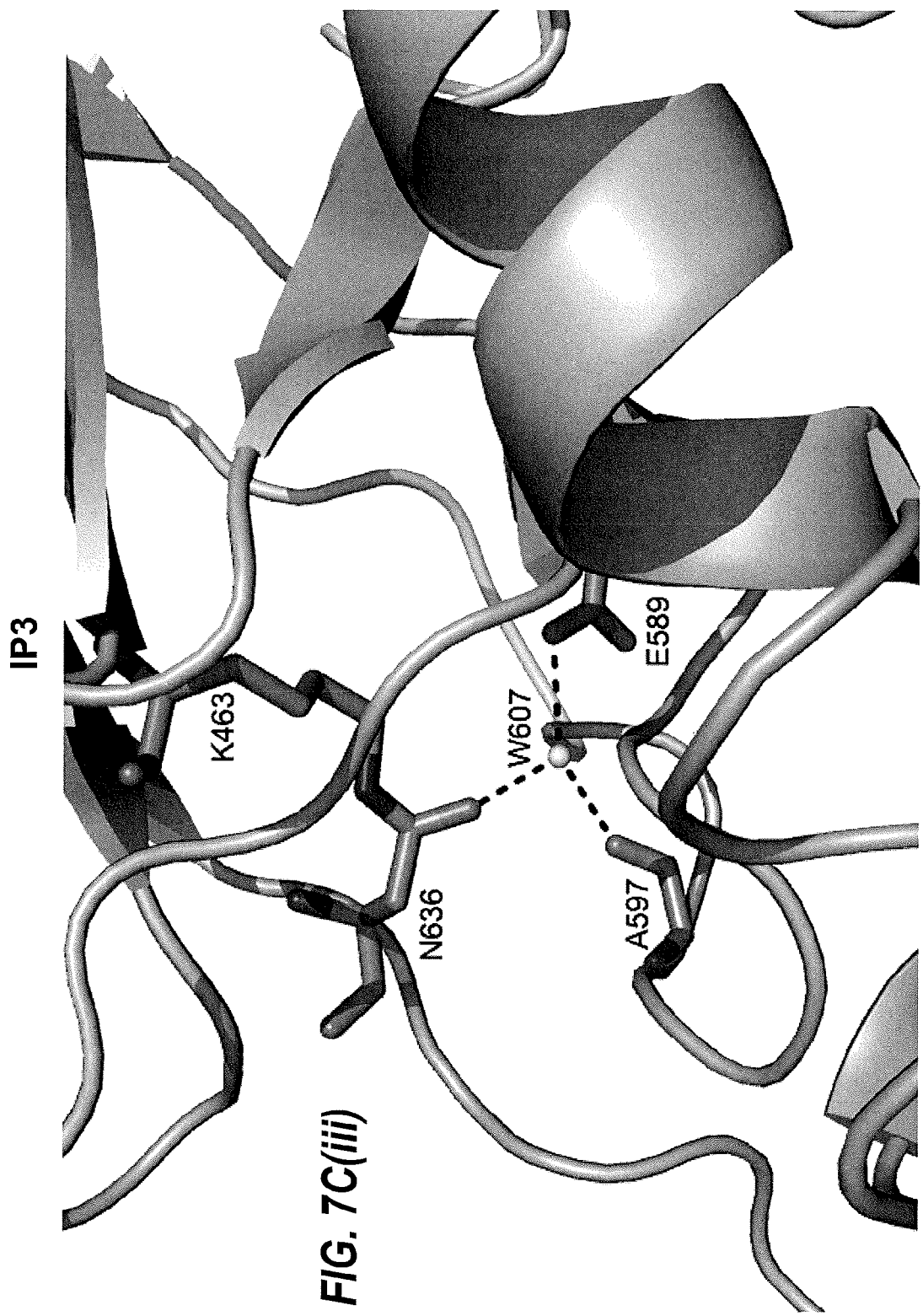
FIG. 7C(iii)

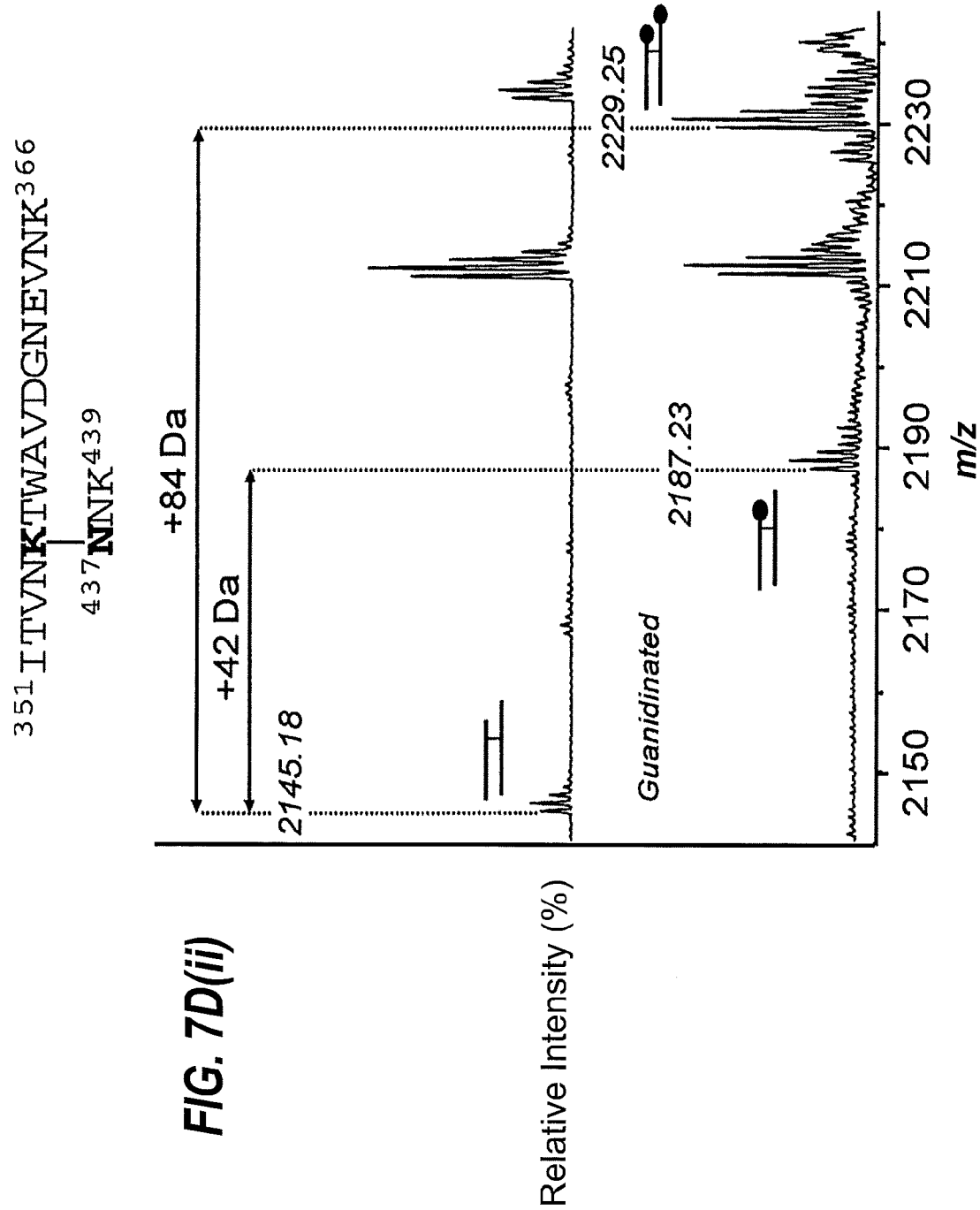
FIG. 7D(ii)

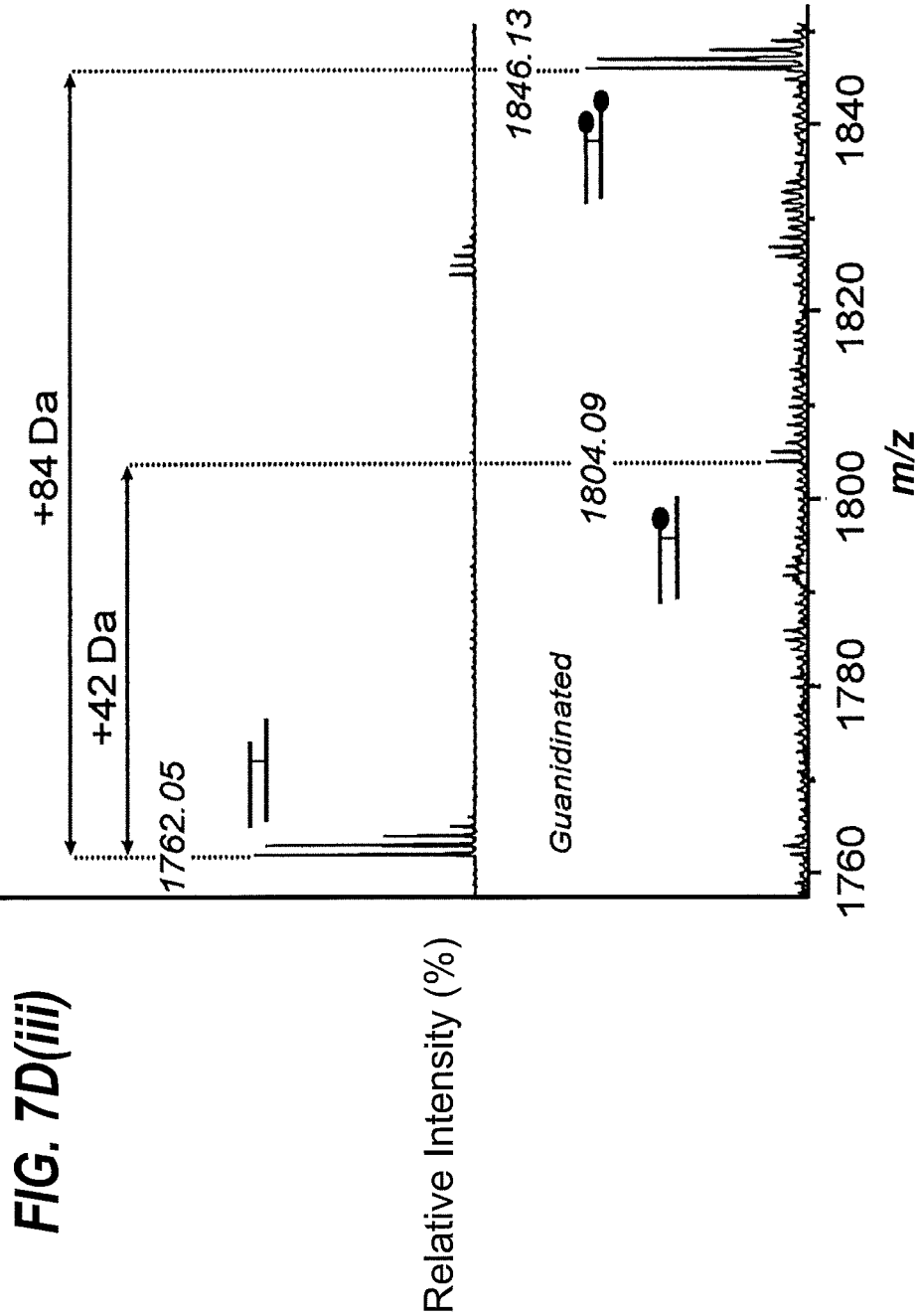
FIG. 7D(iii)

IMMUNOGENIC PROTEINS AND COMPOSITIONS FOR THE TREATMENT AND PREVENTION OF *STREPTOCOCCUS AGALACTIAE*

This application incorporates by reference the contents of a 621 kb text file created on Sep. 4, 2014 and named "PAT053921substitutesequencelisting2.txt," which is the sequence listing for this application.

TECHNICAL FIELD

The invention provides proteins and compositions for the treatment and prevention of *Streptococcus agalactiae* (Group B *streptococcus*; GBS).

BACKGROUND ART

The Gram-positive bacterium *Streptococcus agalactiae* (or "group B *streptococcus*", abbreviated to "GBS") causes serious disease, bacteremia and meningitis, in immunocompromised individuals and in neonates. There are two types of neonatal infection. The first (early onset, usually within 5 days of birth) is manifested by bacteremia and pneumonia. It is contracted vertically as a baby passes through the birth canal. GBS colonises the vagina of about 25% of young women, and approximately 1% of infants born via a vaginal birth to colonised mothers will become infected. Mortality is between 50-70%. The second is a meningitis that occurs 10 to 60 days after birth. If pregnant women are vaccinated with type III capsule so that the infants are passively immunised, the incidence of the late onset meningitis is reduced but is not entirely eliminated.

The "B" in "GBS" refers to the Lancefield classification, which is based on the antigenicity of a carbohydrate which is soluble in dilute acid and called the C carbohydrate. Lancefield identified 13 types of C carbohydrate, designated A to O, that could be serologically differentiated. The organisms that most commonly infect humans are found in groups A, B, D, and G. Within group B, strains can be divided into 10 serotypes (Ia, Ib, II, III, IV, V, VI, VII, VIII and XI) based on the structure of their polysaccharide capsule.

Investigations have been conducted into the development of protein-based and polysaccharide-based vaccines against GBS but currently, no GBS vaccine is commercially available. There therefore remains a need for effective vaccines against *S. agalactiae* infection.

It is an object of the invention to provide proteins and immunogenic compositions which can be used in the development of such vaccines.

DISCLOSURE OF THE INVENTION

Pilus structures in gram-positive bacteria are considered to be interesting vaccine candidates. GBS has three pilus variants, each encoded by a distinct pathogenicity island, PI-1, PI-2a and PI-2b [1, 2]. Each pathogenicity island consists of 5 genes coding for: the pilus backbone protein (BP); 2 ancillary proteins (AP1 and AP2); and 2 sortase proteins that are involved in the assembly of the pili. All GBS strains carry at least one of these 3 pathogenicity islands and the sequences of the pilus structural proteins (BP, AP1 and AP2) encoded by these pathogenicity islands are generally well conserved. However, the sequence of the backbone protein encoded by pathogenicity island 2a (BP-2a), referred to herein as GBS59, varies between GBS strains. The GBS59 pilus subunit has at least seven clades and the sequence identity between these clades is as low as 48%.

Reference amino acid sequences for the seven GBS59 clades are SEQ ID NO:1 (derived from GBS strain 2603), SEQ ID NO:2 (derived from GBS strain 515), SEQ ID NO:3 (derived from GBS strain CJB111), SEQ ID NO:4 (derived from GBS strain H36B), SEQ ID NO:5 (derived from GBS strain CJB110), SEQ ID NO:6 (derived from GBS strain DK21) and SEQ ID NO:7 (derived from GBS strain NEM316) herein.

Serum raised against a given GBS59 clade is active against other strains of GBS that express that clade, but is not active against strains which express one of the other five clades, i.e. there is intra-clade cross-protection, but not inter-clade cross-protection.

According to the invention, therefore, an immunogenic composition is provided which includes at least two different clades of GBS59. The different clades of GBS59 may be present in the immunogenic composition as separate polypeptides or may be fused as a single polypeptide chain. The inclusion of multiple GBS59 clades as vaccine components improves the strain coverage of the immunogenic composition against GBS.

Furthermore, the inventors have identified domains within the GBS59 clades containing epitopes responsible for inducing an immunogenic response. The immunogenic composition may therefore include fragments of at least two different clades of GBS59 comprising one or more of these domains, or sub-fragments of these domains, instead of the full-length GBS59 proteins. Alternatively, these fragments of at least two different clades of GBS59 may be fused as a single polypeptide chain. The use of fragments of GBS59 clades in place of full-length proteins facilitates the preparation of a vaccine with improved strain coverage against GBS.

Thus, the invention provides an immunogenic composition comprising at least two of:
  a) a first polypeptide comprising a first amino acid sequence, wherein the first amino acid sequence comprises an amino acid sequence (i) having at least a % sequence identity to SEQ ID NO:1 and/or (ii) consisting of a fragment of at least t contiguous amino acids from SEQ ID NO:1 or from a sequence having at least a % sequence identity to SEQ ID NO:1;
  b) a second polypeptide comprising a second amino acid sequence, wherein the second amino acid sequence comprises an amino acid sequence (i) having at least b % sequence identity to SEQ ID NO:2 and/or (ii) consisting of a fragment of at least u contiguous amino acids from SEQ ID NO:2 or from a sequence having at least b % sequence identity to SEQ ID NO:1;
  c) a third polypeptide comprising a third amino acid sequence, wherein the third amino acid sequence comprises an amino acid sequence (i) having at least c % sequence identity to SEQ ID NO:3 and/or (ii) consisting of a fragment of at least v contiguous amino acids from SEQ ID NO:3 or from a sequence having at least c % sequence identity to SEQ ID NO:3;
  d) a fourth polypeptide comprising a fourth amino acid sequence, wherein the fourth amino acid sequence comprises an amino acid sequence (i) having at least d % sequence identity to SEQ ID NO:4 and/or (ii) consisting of a fragment of at least w contiguous amino acids from SEQ ID NO:4 or from a sequence having at least d % sequence identity to SEQ ID NO:4;
  e) a fifth polypeptide comprising a fifth amino acid sequence, wherein the fifth amino acid sequence comprises an amino acid sequence (i) having at least e % sequence identity to SEQ ID NO:5 and/or (ii) consisting of a fragment of at least x contiguous amino acids from SEQ ID NO:5 or from a sequence having at least e % sequence identity to SEQ ID NO:5; and/or f) a sixth polypeptide comprising a sixth amino acid sequence, wherein the sixth amino acid sequence comprises an amino acid sequence (i) having at least f % sequence identity to SEQ ID NO:6 and/or (ii) consisting of a fragment of at least y contiguous amino acids from SEQ ID NO:6 or from a sequence having at least f % sequence identity to SEQ ID NO:6; and/or g) a seventh polypeptide comprising a seventh amino acid sequence, wherein the seventh amino acid sequence comprises an amino acid sequence (i) having at least g % sequence identity to SEQ ID NO:7 and/or (ii) consisting of a fragment of at least z contiguous amino acids from SEQ ID NO:7 or from a sequence having at least g % sequence identity to SEQ ID NO:7.

The immunogenic composition may comprise 2, 3, 4, 5, 6 or all 7 of the seven amino acid sequences.

The invention also provides a polypeptide comprising at least two of:

a) a first polypeptide comprising a first amino acid sequence, wherein the first amino acid sequence comprises an amino acid sequence (i) having at least a % sequence identity to SEQ ID NO:1 and/or (ii) consisting of a fragment of at least t contiguous amino acids from SEQ ID NO:1 or from a sequence having at least a % sequence identity to SEQ ID NO:1;

b) a second polypeptide comprising a second amino acid sequence, wherein the second amino acid sequence comprises an amino acid sequence (i) having at least b % sequence identity to SEQ ID NO:2 and/or (ii) consisting of a fragment of at least u contiguous amino acids from SEQ ID NO:2 or from a sequence having at least b % sequence identity to SEQ ID NO:1;

c) a third polypeptide comprising a third amino acid sequence, wherein the third amino acid sequence comprises an amino acid sequence (i) having at least c % sequence identity to SEQ ID NO:3 and/or (ii) consisting of a fragment of at least v contiguous amino acids from SEQ ID NO:3 or from a sequence having at least c % sequence identity to SEQ ID NO:3;

d) a fourth polypeptide comprising a fourth amino acid sequence, wherein the fourth amino acid sequence comprises an amino acid sequence (i) having at least d % sequence identity to SEQ ID NO:4 and/or (ii) consisting of a fragment of at least w contiguous amino acids from SEQ ID NO:4 or from a sequence having at least d % sequence identity to SEQ ID NO:4;

e) a fifth polypeptide comprising a fifth amino acid sequence, wherein the fifth amino acid sequence comprises an amino acid sequence (i) having at least e % sequence identity to SEQ ID NO:5 and/or (ii) consisting of a fragment of at least x contiguous amino acids from SEQ ID NO:5 or from a sequence having at least e % sequence identity to SEQ ID NO:5; and/or f) a sixth polypeptide comprising a sixth amino acid sequence, wherein the sixth amino acid sequence comprises an amino acid sequence (i) having at least f % sequence identity to SEQ ID NO:6 and/or (ii) consisting of a fragment of at least y contiguous amino acids from SEQ ID NO:6 or from a sequence having at least f % sequence identity to SEQ ID NO:6; and/or g) a seventh polypeptide comprising a seventh amino acid sequence, wherein the seventh amino acid sequence comprises an amino acid sequence (i) having at least g % sequence identity to SEQ ID NO:7 and/or (ii) consisting of a fragment of at least z contiguous amino acids from SEQ ID NO:7 or from a sequence having at least g % sequence identity to SEQ ID NO:7.

The polypeptide may comprise 2, 3, 4, 5, 6 or all 7 of the seven amino acid sequences.

The invention also provides a polypeptide comprising amino acid sequence:

-A-{—X-L-}$_n$-B— wherein: X is an amino acid sequence of a first polypeptide, second polypeptide, third polypeptide, fourth polypeptide, fifth polypeptide, sixth polypeptide or seventh polypeptide as defined above; L is an optional linker amino acid sequence; A is an optional N-terminal amino acid sequence; B is an optional C-terminal amino acid sequence; n is an integer or 2 or more. Typically, n is 2, 3, 4, 5, 6 or 7. The X moieties in the polypeptide are different, as discussed below.

Where n is 2, X moieties are selected from the following:

| n | $X_1$ | $X_2$ |
|---|---|---|
| 2 | First polypeptide | Second polypeptide |
| 2 | Second polypeptide | First polypeptide |
| 2 | First polypeptide | Third polypeptide |
| 2 | Third polypeptide | First polypeptide |
| 2 | First polypeptide | Fourth polypeptide |
| 2 | Fourth polypeptide | First polypeptide |
| 2 | Fifth polypeptide | First polypeptide |
| 2 | First polypeptide | Sixth polypeptide |
| 2 | Sixth polypeptide | First polypeptide |
| 2 | Second polypeptide | Third polypeptide |
| 2 | Third polypeptide | Second polypeptide |
| 2 | Second polypeptide | Fourth polypeptide |
| 2 | Fourth polypeptide | Second polypeptide |
| 2 | Second polypeptide | Fifth polypeptide |
| 2 | Fifth polypeptide | Second polypeptide |
| 2 | Second polypeptide | Sixth polypeptide |
| 2 | Sixth polypeptide | Second polypeptide |
| 2 | Third polypeptide | Fourth polypeptide |
| 2 | Fourth polypeptide | Third polypeptide |
| 2 | Third polypeptide | Fifth polypeptide |
| 2 | Fifth polypeptide | Third polypeptide |
| 2 | Third polypeptide | Sixth polypeptide |
| 2 | Sixth polypeptide | Third polypeptide |
| 2 | Fourth polypeptide | Fifth polypeptide |
| 2 | Fifth polypeptide | Fourth polypeptide |
| 2 | Fourth polypeptide e | Sixth polypeptide |
| 2 | Sixth polypeptide | Fourth polypeptide |
| 2 | Fifth polypeptide | Sixth polypeptide |
| 2 | Sixth polypeptide | Fifth polypeptide |

Where n is 3, X moieties are selected from the following:

| n | $X_1$ | $X_2$ | $X_3$ |
|---|---|---|---|
| 3 | First Polypeptide | Second Polypeptide | Third Polypeptide |
| 3 | First Polypeptide | Second Polypeptide | Fourth Polypeptide |
| 3 | First Polypeptide | Second Polypeptide | Fifth Polypeptide |
| 3 | First Polypeptide | Second Polypeptide | Sixth Polypeptide |
| 3 | First Polypeptide | Third Polypeptide | Second Polypeptide |
| 3 | First Polypeptide | Third Polypeptide | Fourth Polypeptide |
| 3 | First Polypeptide | Third Polypeptide | Fifth Polypeptide |
| 3 | First Polypeptide | Third Polypeptide | Sixth Polypeptide |
| 3 | First Polypeptide | Fourth Polypeptide | Second Polypeptide |
| 3 | First Polypeptide | Fourth Polypeptide | Third Polypeptide |
| 3 | First Polypeptide | Fourth Polypeptide | Fifth Polypeptide |
| 3 | First Polypeptide | Fourth Polypeptide | Sixth Polypeptide |
| 3 | First Polypeptide | Fifth Polypeptide | Second Polypeptide |
| 3 | First Polypeptide | Fifth Polypeptide | Third Polypeptide |
| 3 | First Polypeptide | Fifth Polypeptide | Fourth Polypeptide |
| 3 | First Polypeptide | Fifth Polypeptide | Sixth Polypeptide |

-continued

| n | $X_1$ | $X_2$ | $X_3$ |
|---|---|---|---|
| 3 | First Polypeptide | Sixth Polypeptide | Second Polypeptide |
| 3 | First Polypeptide | Sixth Polypeptide | Third Polypeptide |
| 3 | First Polypeptide | Sixth Polypeptide | Fourth Polypeptide |
| 3 | First Polypeptide | Sixth Polypeptide | Fifth Polypeptide |
| 3 | Second Polypeptide | First Polypeptide | Third Polypeptide |
| 3 | Second Polypeptide | First Polypeptide | Fourth Polypeptide |
| 3 | Second Polypeptide | First Polypeptide | Fifth Polypeptide |
| 3 | Second Polypeptide | First Polypeptide | Sixth Polypeptide |
| 3 | Second Polypeptide | Third Polypeptide | First Polypeptide |
| 3 | Second Polypeptide | Third Polypeptide | Fourth Polypeptide |
| 3 | Second Polypeptide | Third Polypeptide | Fifth Polypeptide |
| 3 | Second Polypeptide | Third Polypeptide | Sixth Polypeptide |
| 3 | Second Polypeptide | Fourth Polypeptide | First Polypeptide |
| 3 | Second Polypeptide | Fourth Polypeptide | Third Polypeptide |
| 3 | Second Polypeptide | Fourth Polypeptide | Fifth Polypeptide |
| 3 | Second Polypeptide | Fourth Polypeptide | Sixth Polypeptide |
| 3 | Second Polypeptide | Fifth Polypeptide | First Polypeptide |
| 3 | Second Polypeptide | Fifth Polypeptide | Third Polypeptide |
| 3 | Second Polypeptide | Fifth Polypeptide | Fourth Polypeptide |
| 3 | Second Polypeptide | Fifth Polypeptide | Sixth Polypeptide |
| 3 | Second Polypeptide | Sixth Polypeptide | First Polypeptide |
| 3 | Second Polypeptide | Sixth Polypeptide | Third Polypeptide |
| 3 | Second Polypeptide | Sixth Polypeptide | Fourth Polypeptide |
| 3 | Second Polypeptide | Sixth Polypeptide | Fifth Polypeptide |
| 3 | Third Polypeptide | First Polypeptide | Second Polypeptide |
| 3 | Third Polypeptide | First Polypeptide | Fourth Polypeptide |
| 3 | Third Polypeptide | First Polypeptide | Fifth Polypeptide |
| 3 | Third Polypeptide | First Polypeptide | Sixth Polypeptide |
| 3 | Third Polypeptide | Second Polypeptide | First Polypeptide |
| 3 | Third Polypeptide | Second Polypeptide | Fourth Polypeptide |
| 3 | Third Polypeptide | Second Polypeptide | Fifth Polypeptide |
| 3 | Third Polypeptide | Second Polypeptide | Sixth Polypeptide |
| 3 | Third Polypeptide | Fourth Polypeptide | First Polypeptide |
| 3 | Third Polypeptide | Fourth Polypeptide | Second Polypeptide |
| 3 | Third Polypeptide | Fourth Polypeptide | Fifth Polypeptide |
| 3 | Third Polypeptide | Fourth Polypeptide | Sixth Polypeptide |
| 3 | Third Polypeptide | Fifth Polypeptide | First Polypeptide |
| 3 | Third Polypeptide | Fifth Polypeptide | Second Polypeptide |
| 3 | Third Polypeptide | Fifth Polypeptide | Fourth Polypeptide |
| 3 | Third Polypeptide | Fifth Polypeptide | Sixth Polypeptide |
| 3 | Third Polypeptide | Sixth Polypeptide | First Polypeptide |
| 3 | Third Polypeptide | Sixth Polypeptide | Second Polypeptide |
| 3 | Third Polypeptide | Sixth Polypeptide | Fourth Polypeptide |
| 3 | Third Polypeptide | Sixth Polypeptide | Fifth Polypeptide |
| 3 | Fourth Polypeptide | First Polypeptide | Second Polypeptide |
| 3 | Fourth Polypeptide | First Polypeptide | Third Polypeptide |
| 3 | Fourth Polypeptide | First Polypeptide | Fifth Polypeptide |
| 3 | Fourth Polypeptide | First Polypeptide | Sixth Polypeptide |
| 3 | Fourth Polypeptide | Second Polypeptide | First Polypeptide |
| 3 | Fourth Polypeptide | Second Polypeptide | Third Polypeptide |
| 3 | Fourth Polypeptide | Second Polypeptide | Fifth Polypeptide |
| 3 | Fourth Polypeptide | Second Polypeptide | Sixth Polypeptide |
| 3 | Fourth Polypeptide | Third Polypeptide | First Polypeptide |

-continued

| n | $X_1$ | $X_2$ | $X_3$ |
|---|---|---|---|
| 3 | Fourth Polypeptide | Third Polypeptide | Second Polypeptide |
| 3 | Fourth Polypeptide | Third Polypeptide | Fifth Polypeptide |
| 3 | Fourth Polypeptide | Third Polypeptide | Sixth Polypeptide |
| 3 | Fourth Polypeptide | Fifth Polypeptide | First Polypeptide |
| 3 | Fourth Polypeptide | Fifth Polypeptide | Second Polypeptide |
| 3 | Fourth Polypeptide | Fifth Polypeptide | Third Polypeptide |
| 3 | Fourth Polypeptide | Fifth Polypeptide | Sixth Polypeptide |
| 3 | Fourth Polypeptide | Sixth Polypeptide | First Polypeptide |
| 3 | Fourth Polypeptide | Sixth Polypeptide | Second Polypeptide |
| 3 | Fourth Polypeptide | Sixth Polypeptide | Third Polypeptide |
| 3 | Fourth Polypeptide | Sixth Polypeptide | Fifth Polypeptide |
| 3 | Fifth Polypeptide | First Polypeptide | Second Polypeptide |
| 3 | Fifth Polypeptide | First Polypeptide | Third Polypeptide |
| 3 | Fifth Polypeptide | First Polypeptide | Fourth Polypeptide |
| 3 | Fifth Polypeptide | First Polypeptide | Sixth Polypeptide |
| 3 | Fifth Polypeptide | Second Polypeptide | First Polypeptide |
| 3 | Fifth Polypeptide | Second Polypeptide | Third Polypeptide |
| 3 | Fifth Polypeptide | Second Polypeptide | Fourth Polypeptide |
| 3 | Fifth Polypeptide | Second Polypeptide | Sixth Polypeptide |
| 3 | Fifth Polypeptide | Third Polypeptide | First Polypeptide |
| 3 | Fifth Polypeptide | Third Polypeptide | Second Polypeptide |
| 3 | Fifth Polypeptide | Third Polypeptide | Fourth Polypeptide |
| 3 | Fifth Polypeptide | Third Polypeptide | Sixth Polypeptide |
| 3 | Fifth Polypeptide | Fourth Polypeptide | First Polypeptide |
| 3 | Fifth Polypeptide | Fourth Polypeptide | Second Polypeptide |
| 3 | Fifth Polypeptide | Fourth Polypeptide | Third Polypeptide |
| 3 | Fifth Polypeptide | Fourth Polypeptide | Sixth Polypeptide |
| 3 | Fifth Polypeptide | Sixth Polypeptide | First Polypeptide |
| 3 | Fifth Polypeptide | Sixth Polypeptide | Second Polypeptide |
| 3 | Fifth Polypeptide | Sixth Polypeptide | Third Polypeptide |
| 3 | Fifth Polypeptide | Sixth Polypeptide | Fourth Polypeptide |
| 3 | Sixth Polypeptide | First Polypeptide | Second Polypeptide |
| 3 | Sixth Polypeptide | First Polypeptide | Third Polypeptide |
| 3 | Sixth Polypeptide | First Polypeptide | Fourth Polypeptide |
| 3 | Sixth Polypeptide | First Polypeptide | Fifth Polypeptide |
| 3 | Sixth Polypeptide | Second Polypeptide | First Polypeptide |
| 3 | Sixth Polypeptide | Second Polypeptide | Third Polypeptide |
| 3 | Sixth Polypeptide | Second Polypeptide | Fourth Polypeptide |
| 3 | Sixth Polypeptide | Second Polypeptide | Fifth Polypeptide |
| 3 | Sixth Polypeptide | Third Polypeptide | First Polypeptide |
| 3 | Sixth Polypeptide | Third Polypeptide | Second Polypeptide |
| 3 | Sixth Polypeptide | Third Polypeptide | Fourth Polypeptide |
| 3 | Sixth Polypeptide | Third Polypeptide | Fifth Polypeptide |
| 3 | Sixth Polypeptide | Fourth Polypeptide | First Polypeptide |
| 3 | Sixth Polypeptide | Fourth Polypeptide | Second Polypeptide |
| 3 | Sixth Polypeptide | Fourth Polypeptide | Third Polypeptide |
| 3 | Sixth Polypeptide | Fourth Polypeptide | Fifth Polypeptide |
| 3 | Sixth Polypeptide | Fifth Polypeptide | First Polypeptide |
| 3 | Sixth Polypeptide | Fifth Polypeptide | Second Polypeptide |
| 3 | Sixth Polypeptide | Fifth Polypeptide | Third Polypeptide |
| 3 | Sixth Polypeptide | Fifth Polypeptide | Fourth Polypeptide |

Where n is 4, X moieties are selected from the following:

| n | $X_1$ | $X_2$ | $X_3$ | $X_4$ |
|---|---|---|---|---|
| 4 | First Polypeptide | Second Polypeptide | Third Polypeptide | Fourth Polypeptide |
| 4 | First Polypeptide | Second Polypeptide | Third Polypeptide | Fifth Polypeptide |
| 4 | First Polypeptide | Second Polypeptide | Third Polypeptide | Sixth Polypeptide |
| 4 | First Polypeptide | Second Polypeptide | Fourth Polypeptide | Third Polypeptide |
| 4 | First Polypeptide | Second Polypeptide | Fourth Polypeptide | Fifth Polypeptide |
| 4 | First Polypeptide | Second Polypeptide | Fourth Polypeptide | Sixth Polypeptide |
| 4 | First Polypeptide | Second Polypeptide | Fifth Polypeptide | Third Polypeptide |
| 4 | First Polypeptide | Second Polypeptide | Fifth Polypeptide | Fourth Polypeptide |
| 4 | First Polypeptide | Second Polypeptide | Fifth Polypeptide | Sixth Polypeptide |
| 4 | First Polypeptide | Second Polypeptide | Sixth Polypeptide | Third Polypeptide |
| 4 | First Polypeptide | Second Polypeptide | Sixth Polypeptide | Fourth Polypeptide |
| 4 | First Polypeptide | Second Polypeptide | Sixth Polypeptide | Fifth Polypeptide |
| 4 | First Polypeptide | Third Polypeptide | Second Polypeptide | Fourth Polypeptide |
| 4 | First Polypeptide | Third Polypeptide | Second Polypeptide | Fifth Polypeptide |
| 4 | First Polypeptide | Third Polypeptide | Second Polypeptide | Sixth Polypeptide |
| 4 | First Polypeptide | Third Polypeptide | Fourth Polypeptide | Second Polypeptide |
| 4 | First Polypeptide | Third Polypeptide | Fourth Polypeptide | Fifth Polypeptide |
| 4 | First Polypeptide | Third Polypeptide | Fourth Polypeptide | Sixth Polypeptide |
| 4 | First Polypeptide | Third Polypeptide | Fifth Polypeptide | Second Polypeptide |

| n | X₁ | X₂ | X₃ | X₄ |
|---|---|---|---|---|
| 4 | First Polypeptide | Third Polypeptide | Fifth Polypeptide | Fourth Polypeptide |
| 4 | First Polypeptide | Third Polypeptide | Fifth Polypeptide | Sixth Polypeptide |
| 4 | First Polypeptide | Third Polypeptide | Sixth Polypeptide | Second Polypeptide |
| 4 | First Polypeptide | Third Polypeptide | Sixth Polypeptide | Fourth Polypeptide |
| 4 | First Polypeptide | Third Polypeptide | Sixth Polypeptide | Fifth Polypeptide |
| 4 | First Polypeptide | Fourth Polypeptide | Second Polypeptide | Third Polypeptide |
| 4 | First Polypeptide | Fourth Polypeptide | Second Polypeptide | Fifth Polypeptide |
| 4 | First Polypeptide | Fourth Polypeptide | Second Polypeptide | Sixth Polypeptide |
| 4 | First Polypeptide | Fourth Polypeptide | Third Polypeptide | Second Polypeptide |
| 4 | First Polypeptide | Fourth Polypeptide | Third Polypeptide | Fifth Polypeptide |
| 4 | First Polypeptide | Fourth Polypeptide | Third Polypeptide | Sixth Polypeptide |
| 4 | First Polypeptide | Fourth Polypeptide | Fifth Polypeptide | Second Polypeptide |
| 4 | First Polypeptide | Fourth Polypeptide | Fifth Polypeptide | Third Polypeptide |
| 4 | First Polypeptide | Fourth Polypeptide | Fifth Polypeptide | Sixth Polypeptide |
| 4 | First Polypeptide | Fourth Polypeptide | Sixth Polypeptide | Second Polypeptide |
| 4 | First Polypeptide | Fourth Polypeptide | Sixth Polypeptide | Third Polypeptide |
| 4 | First Polypeptide | Fourth Polypeptide | Sixth Polypeptide | Fifth Polypeptide |
| 4 | First Polypeptide | Fifth Polypeptide | Second Polypeptide | Third Polypeptide |
| 4 | First Polypeptide | Fifth Polypeptide | Second Polypeptide | Fourth Polypeptide |
| 4 | First Polypeptide | Fifth Polypeptide | Second Polypeptide | Sixth Polypeptide |
| 4 | First Polypeptide | Fifth Polypeptide | Third Polypeptide | Second Polypeptide |
| 4 | First Polypeptide | Fifth Polypeptide | Third Polypeptide | Fourth Polypeptide |
| 4 | First Polypeptide | Fifth Polypeptide | Third Polypeptide | Sixth Polypeptide |
| 4 | First Polypeptide | Fifth Polypeptide | Fourth Polypeptide | Second Polypeptide |
| 4 | First Polypeptide | Fifth Polypeptide | Fourth Polypeptide | Third Polypeptide |
| 4 | First Polypeptide | Fifth Polypeptide | Fourth Polypeptide | Sixth Polypeptide |
| 4 | First Polypeptide | Fifth Polypeptide | Sixth Polypeptide | Second Polypeptide |
| 4 | First Polypeptide | Fifth Polypeptide | Sixth Polypeptide | Third Polypeptide |
| 4 | First Polypeptide | Fifth Polypeptide | Sixth Polypeptide | Fourth Polypeptide |
| 4 | First Polypeptide | Sixth Polypeptide | Second Polypeptide | Third Polypeptide |
| 4 | First Polypeptide | Sixth Polypeptide | Second Polypeptide | Fourth Polypeptide |
| 4 | First Polypeptide | Sixth Polypeptide | Second Polypeptide | Fifth Polypeptide |
| 4 | First Polypeptide | Sixth Polypeptide | Third Polypeptide | Second Polypeptide |
| 4 | First Polypeptide | Sixth Polypeptide | Third Polypeptide | Fourth Polypeptide |
| 4 | First Polypeptide | Sixth Polypeptide | Third Polypeptide | Fifth Polypeptide |
| 4 | First Polypeptide | Sixth Polypeptide | Fourth Polypeptide | Second Polypeptide |
| 4 | First Polypeptide | Sixth Polypeptide | Fourth Polypeptide | Third Polypeptide |
| 4 | First Polypeptide | Sixth Polypeptide | Fourth Polypeptide | Fifth Polypeptide |
| 4 | First Polypeptide | Sixth Polypeptide | Fifth Polypeptide | Second Polypeptide |
| 4 | First Polypeptide | Sixth Polypeptide | Fifth Polypeptide | Third Polypeptide |
| 4 | First Polypeptide | Sixth Polypeptide | Fifth Polypeptide | Fourth Polypeptide |
| 4 | Second Polypeptide | First Polypeptide | Third Polypeptide | Fourth Polypeptide |
| 4 | Second Polypeptide | First Polypeptide | Third Polypeptide | Fifth Polypeptide |
| 4 | Second Polypeptide | First Polypeptide | Third Polypeptide | Sixth Polypeptide |
| 4 | Second Polypeptide | First Polypeptide | Fourth Polypeptide | Third Polypeptide |
| 4 | Second Polypeptide | First Polypeptide | Fourth Polypeptide | Fifth Polypeptide |
| 4 | Second Polypeptide | First Polypeptide | Fourth Polypeptide | Sixth Polypeptide |
| 4 | Second Polypeptide | First Polypeptide | Fifth Polypeptide | Third Polypeptide |
| 4 | Second Polypeptide | First Polypeptide | Fifth Polypeptide | Fourth Polypeptide |
| 4 | Second Polypeptide | First Polypeptide | Fifth Polypeptide | Sixth Polypeptide |
| 4 | Second Polypeptide | First Polypeptide | Sixth Polypeptide | Third Polypeptide |
| 4 | Second Polypeptide | First Polypeptide | Sixth Polypeptide | Fourth Polypeptide |
| 4 | Second Polypeptide | First Polypeptide | Sixth Polypeptide | Fifth Polypeptide |
| 4 | Second Polypeptide | Third Polypeptide | First Polypeptide | Fourth Polypeptide |
| 4 | Second Polypeptide | Third Polypeptide | First Polypeptide | Fifth Polypeptide |
| 4 | Second Polypeptide | Third Polypeptide | First Polypeptide | Sixth Polypeptide |
| 4 | Second Polypeptide | Third Polypeptide | Fourth Polypeptide | First Polypeptide |
| 4 | Second Polypeptide | Third Polypeptide | Fourth Polypeptide | Fifth Polypeptide |
| 4 | Second Polypeptide | Third Polypeptide | Fourth Polypeptide | Sixth Polypeptide |
| 4 | Second Polypeptide | Third Polypeptide | Fifth Polypeptide | First Polypeptide |
| 4 | Second Polypeptide | Third Polypeptide | Fifth Polypeptide | Fourth Polypeptide |
| 4 | Second Polypeptide | Third Polypeptide | Fifth Polypeptide | Sixth Polypeptide |
| 4 | Second Polypeptide | Third Polypeptide | Sixth Polypeptide | First Polypeptide |
| 4 | Second Polypeptide | Third Polypeptide | Sixth Polypeptide | Fourth Polypeptide |
| 4 | Second Polypeptide | Third Polypeptide | Sixth Polypeptide | Fifth Polypeptide |
| 4 | Second Polypeptide | Fourth Polypeptide | First Polypeptide | Third Polypeptide |
| 4 | Second Polypeptide | Fourth Polypeptide | First Polypeptide | Fifth Polypeptide |
| 4 | Second Polypeptide | Fourth Polypeptide | First Polypeptide | Sixth Polypeptide |
| 4 | Second Polypeptide | Fourth Polypeptide | Third Polypeptide | First Polypeptide |
| 4 | Second Polypeptide | Fourth Polypeptide | Third Polypeptide | Fifth Polypeptide |
| 4 | Second Polypeptide | Fourth Polypeptide | Third Polypeptide | Sixth Polypeptide |
| 4 | Second Polypeptide | Fourth Polypeptide | Fifth Polypeptide | First Polypeptide |
| 4 | Second Polypeptide | Fourth Polypeptide | Fifth Polypeptide | Third Polypeptide |
| 4 | Second Polypeptide | Fourth Polypeptide | Fifth Polypeptide | Sixth Polypeptide |
| 4 | Second Polypeptide | Fourth Polypeptide | Sixth Polypeptide | First Polypeptide |
| 4 | Second Polypeptide | Fourth Polypeptide | Sixth Polypeptide | Third Polypeptide |
| 4 | Second Polypeptide | Fourth Polypeptide | Sixth Polypeptide | Fifth Polypeptide |

-continued

| n | $X_1$ | $X_2$ | $X_3$ | $X_4$ |
|---|---|---|---|---|
| 4 | Second Polypeptide | Fifth Polypeptide | First Polypeptide | Third Polypeptide |
| 4 | Second Polypeptide | Fifth Polypeptide | First Polypeptide | Fourth Polypeptide |
| 4 | Second Polypeptide | Fifth Polypeptide | First Polypeptide | Sixth Polypeptide |
| 4 | Second Polypeptide | Fifth Polypeptide | Third Polypeptide | First Polypeptide |
| 4 | Second Polypeptide | Fifth Polypeptide | Third Polypeptide | Fourth Polypeptide |
| 4 | Second Polypeptide | Fifth Polypeptide | Third Polypeptide | Sixth Polypeptide |
| 4 | Second Polypeptide | Fifth Polypeptide | Fourth Polypeptide | First Polypeptide |
| 4 | Second Polypeptide | Fifth Polypeptide | Fourth Polypeptide | Third Polypeptide |
| 4 | Second Polypeptide | Fifth Polypeptide | Fourth Polypeptide | Sixth Polypeptide |
| 4 | Second Polypeptide | Fifth Polypeptide | Sixth Polypeptide | First Polypeptide |
| 4 | Second Polypeptide | Fifth Polypeptide | Sixth Polypeptide | Third Polypeptide |
| 4 | Second Polypeptide | Fifth Polypeptide | Sixth Polypeptide | Fourth Polypeptide |
| 4 | Second Polypeptide | Sixth Polypeptide | First Polypeptide | Third Polypeptide |
| 4 | Second Polypeptide | Sixth Polypeptide | First Polypeptide | Fourth Polypeptide |
| 4 | Second Polypeptide | Sixth Polypeptide | First Polypeptide | Fifth Polypeptide |
| 4 | Second Polypeptide | Sixth Polypeptide | Third Polypeptide | First Polypeptide |
| 4 | Second Polypeptide | Sixth Polypeptide | Third Polypeptide | Fourth Polypeptide |
| 4 | Second Polypeptide | Sixth Polypeptide | Third Polypeptide | Fifth Polypeptide |
| 4 | Second Polypeptide | Sixth Polypeptide | Fourth Polypeptide | First Polypeptide |
| 4 | Second Polypeptide | Sixth Polypeptide | Fourth Polypeptide | Third Polypeptide |
| 4 | Second Polypeptide | Sixth Polypeptide | Fourth Polypeptide | Fifth Polypeptide |
| 4 | Second Polypeptide | Sixth Polypeptide | Fifth Polypeptide | First Polypeptide |
| 4 | Second Polypeptide | Sixth Polypeptide | Fifth Polypeptide | Third Polypeptide |
| 4 | Second Polypeptide | Sixth Polypeptide | Fifth Polypeptide | Fourth Polypeptide |
| 4 | Third Polypeptide | First Polypeptide | Second Polypeptide | Fourth Polypeptide |
| 4 | Third Polypeptide | First Polypeptide | Second Polypeptide | Fifth Polypeptide |
| 4 | Third Polypeptide | First Polypeptide | Second Polypeptide | Sixth Polypeptide |
| 4 | Third Polypeptide | First Polypeptide | Fourth Polypeptide | Second Polypeptide |
| 4 | Third Polypeptide | First Polypeptide | Fourth Polypeptide | Fifth Polypeptide |
| 4 | Third Polypeptide | First Polypeptide | Fourth Polypeptide | Sixth Polypeptide |
| 4 | Third Polypeptide | First Polypeptide | Fifth Polypeptide | Second Polypeptide |
| 4 | Third Polypeptide | First Polypeptide | Fifth Polypeptide | Fourth Polypeptide |
| 4 | Third Polypeptide | First Polypeptide | Fifth Polypeptide | Sixth Polypeptide |
| 4 | Third Polypeptide | First Polypeptide | Sixth Polypeptide | Second Polypeptide |
| 4 | Third Polypeptide | First Polypeptide | Sixth Polypeptide | Fourth Polypeptide |
| 4 | Third Polypeptide | First Polypeptide | Sixth Polypeptide | Fifth Polypeptide |
| 4 | Third Polypeptide | Second Polypeptide | First Polypeptide | Fourth Polypeptide |
| 4 | Third Polypeptide | Second Polypeptide | First Polypeptide | Fifth Polypeptide |
| 4 | Third Polypeptide | Second Polypeptide | First Polypeptide | Sixth Polypeptide |
| 4 | Third Polypeptide | Second Polypeptide | Fourth Polypeptide | First Polypeptide |
| 4 | Third Polypeptide | Second Polypeptide | Fourth Polypeptide | Fifth Polypeptide |
| 4 | Third Polypeptide | Second Polypeptide | Fourth Polypeptide | Sixth Polypeptide |
| 4 | Third Polypeptide | Second Polypeptide | Fifth Polypeptide | First Polypeptide |
| 4 | Third Polypeptide | Second Polypeptide | Fifth Polypeptide | Fourth Polypeptide |
| 4 | Third Polypeptide | Second Polypeptide | Fifth Polypeptide | Sixth Polypeptide |
| 4 | Third Polypeptide | Second Polypeptide | Sixth Polypeptide | First Polypeptide |
| 4 | Third Polypeptide | Second Polypeptide | Sixth Polypeptide | Fourth Polypeptide |
| 4 | Third Polypeptide | Second Polypeptide | Sixth Polypeptide | Fifth Polypeptide |
| 4 | Third Polypeptide | Fourth Polypeptide | First Polypeptide | Second Polypeptide |
| 4 | Third Polypeptide | Fourth Polypeptide | First Polypeptide | Fifth Polypeptide |
| 4 | Third Polypeptide | Fourth Polypeptide | First Polypeptide | Sixth Polypeptide |
| 4 | Third Polypeptide | Fourth Polypeptide | Second Polypeptide | First Polypeptide |
| 4 | Third Polypeptide | Fourth Polypeptide | Second Polypeptide | Fifth Polypeptide |
| 4 | Third Polypeptide | Fourth Polypeptide | Second Polypeptide | Sixth Polypeptide |
| 4 | Third Polypeptide | Fourth Polypeptide | Fifth Polypeptide | First Polypeptide |
| 4 | Third Polypeptide | Fourth Polypeptide | Fifth Polypeptide | Second Polypeptide |
| 4 | Third Polypeptide | Fourth Polypeptide | Fifth Polypeptide | Sixth Polypeptide |
| 4 | Third Polypeptide | Fourth Polypeptide | Sixth Polypeptide | First Polypeptide |
| 4 | Third Polypeptide | Fourth Polypeptide | Sixth Polypeptide | Second Polypeptide |
| 4 | Third Polypeptide | Fourth Polypeptide | Sixth Polypeptide | Fifth Polypeptide |
| 4 | Third Polypeptide | Fifth Polypeptide | First Polypeptide | Second Polypeptide |
| 4 | Third Polypeptide | Fifth Polypeptide | First Polypeptide | Fourth Polypeptide |
| 4 | Third Polypeptide | Fifth Polypeptide | First Polypeptide | Sixth Polypeptide |
| 4 | Third Polypeptide | Fifth Polypeptide | Second Polypeptide | First Polypeptide |
| 4 | Third Polypeptide | Fifth Polypeptide | Second Polypeptide | Fourth Polypeptide |
| 4 | Third Polypeptide | Fifth Polypeptide | Second Polypeptide | Sixth Polypeptide |
| 4 | Third Polypeptide | Fifth Polypeptide | Fourth Polypeptide | First Polypeptide |
| 4 | Third Polypeptide | Fifth Polypeptide | Fourth Polypeptide | Second Polypeptide |
| 4 | Third Polypeptide | Fifth Polypeptide | Fourth Polypeptide | Sixth Polypeptide |
| 4 | Third Polypeptide | Fifth Polypeptide | Sixth Polypeptide | First Polypeptide |
| 4 | Third Polypeptide | Fifth Polypeptide | Sixth Polypeptide | Second Polypeptide |
| 4 | Third Polypeptide | Fifth Polypeptide | Sixth Polypeptide | Fourth Polypeptide |
| 4 | Third Polypeptide | Sixth Polypeptide | First Polypeptide | Second Polypeptide |
| 4 | Third Polypeptide | Sixth Polypeptide | First Polypeptide | Fourth Polypeptide |
| 4 | Third Polypeptide | Sixth Polypeptide | First Polypeptide | Fifth Polypeptide |
| 4 | Third Polypeptide | Sixth Polypeptide | Second Polypeptide | First Polypeptide |
| 4 | Third Polypeptide | Sixth Polypeptide | Second Polypeptide | Fourth Polypeptide |

| n | $X_1$ | $X_2$ | $X_3$ | $X_4$ |
|---|---|---|---|---|
| 4 | Third Polypeptide | Sixth Polypeptide | Second Polypeptide | Fifth Polypeptide |
| 4 | Third Polypeptide | Sixth Polypeptide | Fourth Polypeptide | First Polypeptide |
| 4 | Third Polypeptide | Sixth Polypeptide | Fourth Polypeptide | Second Polypeptide |
| 4 | Third Polypeptide | Sixth Polypeptide | Fourth Polypeptide | Fifth Polypeptide |
| 4 | Third Polypeptide | Sixth Polypeptide | Fifth Polypeptide | First Polypeptide |
| 4 | Third Polypeptide | Sixth Polypeptide | Fifth Polypeptide | Second Polypeptide |
| 4 | Third Polypeptide | Sixth Polypeptide | Fifth Polypeptide | Fourth Polypeptide |
| 4 | Fourth Polypeptide | First Polypeptide | Second Polypeptide | Third Polypeptide |
| 4 | Fourth Polypeptide | First Polypeptide | Second Polypeptide | Fifth Polypeptide |
| 4 | Fourth Polypeptide | First Polypeptide | Second Polypeptide | Sixth Polypeptide |
| 4 | Fourth Polypeptide | First Polypeptide | Third Polypeptide | Second Polypeptide |
| 4 | Fourth Polypeptide | First Polypeptide | Third Polypeptide | Fifth Polypeptide |
| 4 | Fourth Polypeptide | First Polypeptide | Third Polypeptide | Sixth Polypeptide |
| 4 | Fourth Polypeptide | First Polypeptide | Fifth Polypeptide | Second Polypeptide |
| 4 | Fourth Polypeptide | First Polypeptide | Fifth Polypeptide | Third Polypeptide |
| 4 | Fourth Polypeptide | First Polypeptide | Fifth Polypeptide | Sixth Polypeptide |
| 4 | Fourth Polypeptide | First Polypeptide | Sixth Polypeptide | Second Polypeptide |
| 4 | Fourth Polypeptide | First Polypeptide | Sixth Polypeptide | Third Polypeptide |
| 4 | Fourth Polypeptide | First Polypeptide | Sixth Polypeptide | Fifth Polypeptide |
| 4 | Fourth Polypeptide | Second Polypeptide | First Polypeptide | Third Polypeptide |
| 4 | Fourth Polypeptide | Second Polypeptide | First Polypeptide | Fifth Polypeptide |
| 4 | Fourth Polypeptide | Second Polypeptide | First Polypeptide | Sixth Polypeptide |
| 4 | Fourth Polypeptide | Second Polypeptide | Third Polypeptide | First Polypeptide |
| 4 | Fourth Polypeptide | Second Polypeptide | Third Polypeptide | Fifth Polypeptide |
| 4 | Fourth Polypeptide | Second Polypeptide | Third Polypeptide | Sixth Polypeptide |
| 4 | Fourth Polypeptide | Second Polypeptide | Fifth Polypeptide | First Polypeptide |
| 4 | Fourth Polypeptide | Second Polypeptide | Fifth Polypeptide | Third Polypeptide |
| 4 | Fourth Polypeptide | Second Polypeptide | Fifth Polypeptide | Sixth Polypeptide |
| 4 | Fourth Polypeptide | Second Polypeptide | Sixth Polypeptide | First Polypeptide |
| 4 | Fourth Polypeptide | Second Polypeptide | Sixth Polypeptide | Third Polypeptide |
| 4 | Fourth Polypeptide | Second Polypeptide | Sixth Polypeptide | Fifth Polypeptide |
| 4 | Fourth Polypeptide | Third Polypeptide | First Polypeptide | Second Polypeptide |
| 4 | Fourth Polypeptide | Third Polypeptide | First Polypeptide | Fifth Polypeptide |
| 4 | Fourth Polypeptide | Third Polypeptide | First Polypeptide | Sixth Polypeptide |
| 4 | Fourth Polypeptide | Third Polypeptide | Second Polypeptide | First Polypeptide |
| 4 | Fourth Polypeptide | Third Polypeptide | Second Polypeptide | Fifth Polypeptide |
| 4 | Fourth Polypeptide | Third Polypeptide | Second Polypeptide | Sixth Polypeptide |
| 4 | Fourth Polypeptide | Third Polypeptide | Fifth Polypeptide | First Polypeptide |
| 4 | Fourth Polypeptide | Third Polypeptide | Fifth Polypeptide | Second Polypeptide |
| 4 | Fourth Polypeptide | Third Polypeptide | Fifth Polypeptide | Sixth Polypeptide |
| 4 | Fourth Polypeptide | Third Polypeptide | Sixth Polypeptide | First Polypeptide |
| 4 | Fourth Polypeptide | Third Polypeptide | Sixth Polypeptide | Second Polypeptide |
| 4 | Fourth Polypeptide | Third Polypeptide | Sixth Polypeptide | Fifth Polypeptide |
| 4 | Fourth Polypeptide | Fifth Polypeptide | First Polypeptide | Second Polypeptide |
| 4 | Fourth Polypeptide | Fifth Polypeptide | First Polypeptide | Third Polypeptide |
| 4 | Fourth Polypeptide | Fifth Polypeptide | First Polypeptide | Sixth Polypeptide |
| 4 | Fourth Polypeptide | Fifth Polypeptide | Second Polypeptide | First Polypeptide |
| 4 | Fourth Polypeptide | Fifth Polypeptide | Second Polypeptide | Third Polypeptide |
| 4 | Fourth Polypeptide | Fifth Polypeptide | Second Polypeptide | Sixth Polypeptide |
| 4 | Fourth Polypeptide | Fifth Polypeptide | Third Polypeptide | First Polypeptide |
| 4 | Fourth Polypeptide | Fifth Polypeptide | Third Polypeptide | Second Polypeptide |
| 4 | Fourth Polypeptide | Fifth Polypeptide | Third Polypeptide | Sixth Polypeptide |
| 4 | Fourth Polypeptide | Fifth Polypeptide | Sixth Polypeptide | First Polypeptide |
| 4 | Fourth Polypeptide | Fifth Polypeptide | Sixth Polypeptide | Second Polypeptide |
| 4 | Fourth Polypeptide | Fifth Polypeptide | Sixth Polypeptide | Third Polypeptide |
| 4 | Fourth Polypeptide | Sixth Polypeptide | First Polypeptide | Second Polypeptide |
| 4 | Fourth Polypeptide | Sixth Polypeptide | First Polypeptide | Third Polypeptide |
| 4 | Fourth Polypeptide | Sixth Polypeptide | First Polypeptide | Fifth Polypeptide |
| 4 | Fourth Polypeptide | Sixth Polypeptide | Second Polypeptide | First Polypeptide |
| 4 | Fourth Polypeptide | Sixth Polypeptide | Second Polypeptide | Third Polypeptide |
| 4 | Fourth Polypeptide | Sixth Polypeptide | Second Polypeptide | Fifth Polypeptide |
| 4 | Fourth Polypeptide | Sixth Polypeptide | Third Polypeptide | First Polypeptide |
| 4 | Fourth Polypeptide | Sixth Polypeptide | Third Polypeptide | Second Polypeptide |
| 4 | Fourth Polypeptide | Sixth Polypeptide | Third Polypeptide | Fifth Polypeptide |
| 4 | Fourth Polypeptide | Sixth Polypeptide | Fifth Polypeptide | First Polypeptide |
| 4 | Fourth Polypeptide | Sixth Polypeptide | Fifth Polypeptide | Second Polypeptide |
| 4 | Fourth Polypeptide | Sixth Polypeptide | Fifth Polypeptide | Third Polypeptide |
| 4 | Fifth Polypeptide | First Polypeptide | Second Polypeptide | Third Polypeptide |
| 4 | Fifth Polypeptide | First Polypeptide | Second Polypeptide | Fourth Polypeptide |
| 4 | Fifth Polypeptide | First Polypeptide | Second Polypeptide | Sixth Polypeptide |
| 4 | Fifth Polypeptide | First Polypeptide | Third Polypeptide | Second Polypeptide |
| 4 | Fifth Polypeptide | First Polypeptide | Third Polypeptide | Fourth Polypeptide |
| 4 | Fifth Polypeptide | First Polypeptide | Third Polypeptide | Sixth Polypeptide |
| 4 | Fifth Polypeptide | First Polypeptide | Fourth Polypeptide | Second Polypeptide |
| 4 | Fifth Polypeptide | First Polypeptide | Fourth Polypeptide | Third Polypeptide |
| 4 | Fifth Polypeptide | First Polypeptide | Fourth Polypeptide | Sixth Polypeptide |
| 4 | Fifth Polypeptide | First Polypeptide | Sixth Polypeptide | Second Polypeptide |

-continued

| n | X₁ | X₂ | X₃ | X₄ |
|---|---|---|---|---|
| 4 | Fifth Polypeptide | First Polypeptide | Sixth Polypeptide | Third Polypeptide |
| 4 | Fifth Polypeptide | First Polypeptide | Sixth Polypeptide | Fourth Polypeptide |
| 4 | Fifth Polypeptide | Second Polypeptide | First Polypeptide | Third Polypeptide |
| 4 | Fifth Polypeptide | Second Polypeptide | First Polypeptide | Fourth Polypeptide |
| 4 | Fifth Polypeptide | Second Polypeptide | First Polypeptide | Sixth Polypeptide |
| 4 | Fifth Polypeptide | Second Polypeptide | Third Polypeptide | First Polypeptide |
| 4 | Fifth Polypeptide | Second Polypeptide | Third Polypeptide | Fourth Polypeptide |
| 4 | Fifth Polypeptide | Second Polypeptide | Third Polypeptide | Sixth Polypeptide |
| 4 | Fifth Polypeptide | Second Polypeptide | Fourth Polypeptide | First Polypeptide |
| 4 | Fifth Polypeptide | Second Polypeptide | Fourth Polypeptide | Third Polypeptide |
| 4 | Fifth Polypeptide | Second Polypeptide | Fourth Polypeptide | Sixth Polypeptide |
| 4 | Fifth Polypeptide | Second Polypeptide | Sixth Polypeptide | First Polypeptide |
| 4 | Fifth Polypeptide | Second Polypeptide | Sixth Polypeptide | Third Polypeptide |
| 4 | Fifth Polypeptide | Second Polypeptide | Sixth Polypeptide | Fourth Polypeptide |
| 4 | Fifth Polypeptide | Third Polypeptide | First Polypeptide | Second Polypeptide |
| 4 | Fifth Polypeptide | Third Polypeptide | First Polypeptide | Fourth Polypeptide |
| 4 | Fifth Polypeptide | Third Polypeptide | First Polypeptide | Sixth Polypeptide |
| 4 | Fifth Polypeptide | Third Polypeptide | Second Polypeptide | First Polypeptide |
| 4 | Fifth Polypeptide | Third Polypeptide | Second Polypeptide | Fourth Polypeptide |
| 4 | Fifth Polypeptide | Third Polypeptide | Second Polypeptide | Sixth Polypeptide |
| 4 | Fifth Polypeptide | Third Polypeptide | Fourth Polypeptide | First Polypeptide |
| 4 | Fifth Polypeptide | Third Polypeptide | Fourth Polypeptide | Second Polypeptide |
| 4 | Fifth Polypeptide | Third Polypeptide | Fourth Polypeptide | Sixth Polypeptide |
| 4 | Fifth Polypeptide | Third Polypeptide | Sixth Polypeptide | First Polypeptide |
| 4 | Fifth Polypeptide | Third Polypeptide | Sixth Polypeptide | Second Polypeptide |
| 4 | Fifth Polypeptide | Third Polypeptide | Sixth Polypeptide | Fourth Polypeptide |
| 4 | Fifth Polypeptide | Fourth Polypeptide | First Polypeptide | Second Polypeptide |
| 4 | Fifth Polypeptide | Fourth Polypeptide | First Polypeptide | Third Polypeptide |
| 4 | Fifth Polypeptide | Fourth Polypeptide | First Polypeptide | Sixth Polypeptide |
| 4 | Fifth Polypeptide | Fourth Polypeptide | Second Polypeptide | First Polypeptide |
| 4 | Fifth Polypeptide | Fourth Polypeptide | Second Polypeptide | Third Polypeptide |
| 4 | Fifth Polypeptide | Fourth Polypeptide | Second Polypeptide | Sixth Polypeptide |
| 4 | Fifth Polypeptide | Fourth Polypeptide | Third Polypeptide | First Polypeptide |
| 4 | Fifth Polypeptide | Fourth Polypeptide | Third Polypeptide | Second Polypeptide |
| 4 | Fifth Polypeptide | Fourth Polypeptide | Third Polypeptide | Sixth Polypeptide |
| 4 | Fifth Polypeptide | Fourth Polypeptide | Sixth Polypeptide | First Polypeptide |
| 4 | Fifth Polypeptide | Fourth Polypeptide | Sixth Polypeptide | Second Polypeptide |
| 4 | Fifth Polypeptide | Fourth Polypeptide | Sixth Polypeptide | Third Polypeptide |
| 4 | Fifth Polypeptide | Sixth Polypeptide | First Polypeptide | Second Polypeptide |
| 4 | Fifth Polypeptide | Sixth Polypeptide | First Polypeptide | Third Polypeptide |
| 4 | Fifth Polypeptide | Sixth Polypeptide | First Polypeptide | Fourth Polypeptide |
| 4 | Fifth Polypeptide | Sixth Polypeptide | Second Polypeptide | First Polypeptide |
| 4 | Fifth Polypeptide | Sixth Polypeptide | Second Polypeptide | Third Polypeptide |
| 4 | Fifth Polypeptide | Sixth Polypeptide | Second Polypeptide | Fourth Polypeptide |
| 4 | Fifth Polypeptide | Sixth Polypeptide | Third Polypeptide | First Polypeptide |
| 4 | Fifth Polypeptide | Sixth Polypeptide | Third Polypeptide | Second Polypeptide |
| 4 | Fifth Polypeptide | Sixth Polypeptide | Third Polypeptide | Fourth Polypeptide |
| 4 | Fifth Polypeptide | Sixth Polypeptide | Fourth Polypeptide | First Polypeptide |
| 4 | Fifth Polypeptide | Sixth Polypeptide | Fourth Polypeptide | Second Polypeptide |
| 4 | Fifth Polypeptide | Sixth Polypeptide | Fourth Polypeptide | Third Polypeptide |
| 4 | Sixth Polypeptide | First Polypeptide | Second Polypeptide | Third Polypeptide |
| 4 | Sixth Polypeptide | First Polypeptide | Second Polypeptide | Fourth Polypeptide |
| 4 | Sixth Polypeptide | First Polypeptide | Second Polypeptide | Fifth Polypeptide |
| 4 | Sixth Polypeptide | First Polypeptide | Third Polypeptide | Second Polypeptide |
| 4 | Sixth Polypeptide | First Polypeptide | Third Polypeptide | Fourth Polypeptide |
| 4 | Sixth Polypeptide | First Polypeptide | Third Polypeptide | Fifth Polypeptide |
| 4 | Sixth Polypeptide | First Polypeptide | Fourth Polypeptide | Second Polypeptide |
| 4 | Sixth Polypeptide | First Polypeptide | Fourth Polypeptide | Third Polypeptide |
| 4 | Sixth Polypeptide | First Polypeptide | Fourth Polypeptide | Fifth Polypeptide |
| 4 | Sixth Polypeptide | First Polypeptide | Fifth Polypeptide | Second Polypeptide |
| 4 | Sixth Polypeptide | First Polypeptide | Fifth Polypeptide | Third Polypeptide |
| 4 | Sixth Polypeptide | First Polypeptide | Fifth Polypeptide | Fourth Polypeptide |
| 4 | Sixth Polypeptide | Second Polypeptide | First Polypeptide | Third Polypeptide |
| 4 | Sixth Polypeptide | Second Polypeptide | First Polypeptide | Fourth Polypeptide |
| 4 | Sixth Polypeptide | Second Polypeptide | First Polypeptide | Fifth Polypeptide |
| 4 | Sixth Polypeptide | Second Polypeptide | Third Polypeptide | First Polypeptide |
| 4 | Sixth Polypeptide | Second Polypeptide | Third Polypeptide | Fourth Polypeptide |
| 4 | Sixth Polypeptide | Second Polypeptide | Third Polypeptide | Fifth Polypeptide |
| 4 | Sixth Polypeptide | Second Polypeptide | Fourth Polypeptide | First Polypeptide |
| 4 | Sixth Polypeptide | Second Polypeptide | Fourth Polypeptide | Third Polypeptide |
| 4 | Sixth Polypeptide | Second Polypeptide | Fourth Polypeptide | Fifth Polypeptide |
| 4 | Sixth Polypeptide | Second Polypeptide | Fifth Polypeptide | First Polypeptide |
| 4 | Sixth Polypeptide | Second Polypeptide | Fifth Polypeptide | Third Polypeptide |
| 4 | Sixth Polypeptide | Second Polypeptide | Fifth Polypeptide | Fourth Polypeptide |
| 4 | Sixth Polypeptide | Third Polypeptide | First Polypeptide | Second Polypeptide |
| 4 | Sixth Polypeptide | Third Polypeptide | First Polypeptide | Fourth Polypeptide |
| 4 | Sixth Polypeptide | Third Polypeptide | First Polypeptide | Fifth Polypeptide |

-continued

| n | $X_1$ | $X_2$ | $X_3$ | $X_4$ |
|---|---|---|---|---|
| 4 | Sixth Polypeptide | Third Polypeptide | Second Polypeptide | First Polypeptide |
| 4 | Sixth Polypeptide | Third Polypeptide | Second Polypeptide | Fourth Polypeptide |
| 4 | Sixth Polypeptide | Third Polypeptide | Second Polypeptide | Fifth Polypeptide |
| 4 | Sixth Polypeptide | Third Polypeptide | Fourth Polypeptide | First Polypeptide |
| 4 | Sixth Polypeptide | Third Polypeptide | Fourth Polypeptide | Second Polypeptide |
| 4 | Sixth Polypeptide | Third Polypeptide | Fourth Polypeptide | Fifth Polypeptide |
| 4 | Sixth Polypeptide | Third Polypeptide | Fifth Polypeptide | First Polypeptide |
| 4 | Sixth Polypeptide | Third Polypeptide | Fifth Polypeptide | Second Polypeptide |
| 4 | Sixth Polypeptide | Third Polypeptide | Fifth Polypeptide | Fourth Polypeptide |
| 4 | Sixth Polypeptide | Fourth Polypeptide | First Polypeptide | Second Polypeptide |
| 4 | Sixth Polypeptide | Fourth Polypeptide | First Polypeptide | Third Polypeptide |
| 4 | Sixth Polypeptide | Fourth Polypeptide | First Polypeptide | Fifth Polypeptide |
| 4 | Sixth Polypeptide | Fourth Polypeptide | Second Polypeptide | First Polypeptide |
| 4 | Sixth Polypeptide | Fourth Polypeptide | Second Polypeptide | Third Polypeptide |
| 4 | Sixth Polypeptide | Fourth Polypeptide | Second Polypeptide | Fifth Polypeptide |
| 4 | Sixth Polypeptide | Fourth Polypeptide | Third Polypeptide | First Polypeptide |
| 4 | Sixth Polypeptide | Fourth Polypeptide | Third Polypeptide | Second Polypeptide |
| 4 | Sixth Polypeptide | Fourth Polypeptide | Third Polypeptide | Fifth Polypeptide |
| 4 | Sixth Polypeptide | Fourth Polypeptide | Fifth Polypeptide | First Polypeptide |
| 4 | Sixth Polypeptide | Fourth Polypeptide | Fifth Polypeptide | Second Polypeptide |
| 4 | Sixth Polypeptide | Fourth Polypeptide | Fifth Polypeptide | Third Polypeptide |
| 4 | Sixth Polypeptide | Fifth Polypeptide | First Polypeptide | Second Polypeptide |
| 4 | Sixth Polypeptide | Fifth Polypeptide | First Polypeptide | Third Polypeptide |
| 4 | Sixth Polypeptide | Fifth Polypeptide | First Polypeptide | Fourth Polypeptide |
| 4 | Sixth Polypeptide | Fifth Polypeptide | Second Polypeptide | First Polypeptide |
| 4 | Sixth Polypeptide | Fifth Polypeptide | Second Polypeptide | Third Polypeptide |
| 4 | Sixth Polypeptide | Fifth Polypeptide | Second Polypeptide | Fourth Polypeptide |
| 4 | Sixth Polypeptide | Fifth Polypeptide | Third Polypeptide | First Polypeptide |
| 4 | Sixth Polypeptide | Fifth Polypeptide | Third Polypeptide | Second Polypeptide |
| 4 | Sixth Polypeptide | Fifth Polypeptide | Third Polypeptide | Fourth Polypeptide |
| 4 | Sixth Polypeptide | Fifth Polypeptide | Fourth Polypeptide | First Polypeptide |
| 4 | Sixth Polypeptide | Fifth Polypeptide | Fourth Polypeptide | Second Polypeptide |
| 4 | Sixth Polypeptide | Fifth Polypeptide | Fourth Polypeptide | Third Polypeptide |

Where n is 5, X moieties are selected from the following:

| n | $X_1$ | $X_2$ | $X_3$ | $X_4$ | $X_5$ |
|---|---|---|---|---|---|
| 5 | 1st Polypeptide | 2nd Polypeptide | 3rd Polypeptide | 4th Polypeptide | 5th Polypeptide |
| 5 | 1st Polypeptide | 2nd Polypeptide | 3rd Polypeptide | 4th Polypeptide | 6th Polypeptide |
| 5 | 1st Polypeptide | 2nd Polypeptide | 3rd Polypeptide | 5th Polypeptide | 4th Polypeptide |
| 5 | 1st Polypeptide | 2nd Polypeptide | 3rd Polypeptide | 5th Polypeptide | 6th Polypeptide |
| 5 | 1st Polypeptide | 2nd Polypeptide | 3rd Polypeptide | 6th Polypeptide | 4th Polypeptide |
| 5 | 1st Polypeptide | 2nd Polypeptide | 3rd Polypeptide | 6th Polypeptide | 5th Polypeptide |
| 5 | 1st Polypeptide | 2nd Polypeptide | 4th Polypeptide | 3rd Polypeptide | 5th Polypeptide |
| 5 | 1st Polypeptide | 2nd Polypeptide | 4th Polypeptide | 3rd Polypeptide | 6th Polypeptide |
| 5 | 1st Polypeptide | 2nd Polypeptide | 4th Polypeptide | 5th Polypeptide | 3rd Polypeptide |
| 5 | 1st Polypeptide | 2nd Polypeptide | 4th Polypeptide | 5th Polypeptide | 6th Polypeptide |
| 5 | 1st Polypeptide | 2nd Polypeptide | 4th Polypeptide | 6th Polypeptide | 3rd Polypeptide |
| 5 | 1st Polypeptide | 2nd Polypeptide | 4th Polypeptide | 6th Polypeptide | 5th Polypeptide |
| 5 | 1st Polypeptide | 2nd Polypeptide | 5th Polypeptide | 3rd Polypeptide | 4th Polypeptide |
| 5 | 1st Polypeptide | 2nd Polypeptide | 5th Polypeptide | 3rd Polypeptide | 6th Polypeptide |
| 5 | 1st Polypeptide | 2nd Polypeptide | 5th Polypeptide | 4th Polypeptide | 3rd Polypeptide |
| 5 | 1st Polypeptide | 2nd Polypeptide | 5th Polypeptide | 4th Polypeptide | 6th Polypeptide |
| 5 | 1st Polypeptide | 2nd Polypeptide | 5th Polypeptide | 6th Polypeptide | 3rd Polypeptide |
| 5 | 1st Polypeptide | 2nd Polypeptide | 5th Polypeptide | 6th Polypeptide | 4th Polypeptide |
| 5 | 1st Polypeptide | 2nd Polypeptide | 6th Polypeptide | 3rd Polypeptide | 4th Polypeptide |
| 5 | 1st Polypeptide | 2nd Polypeptide | 6th Polypeptide | 3rd Polypeptide | 5th Polypeptide |
| 5 | 1st Polypeptide | 2nd Polypeptide | 6th Polypeptide | 4th Polypeptide | 3rd Polypeptide |
| 5 | 1st Polypeptide | 2nd Polypeptide | 6th Polypeptide | 4th Polypeptide | 5th Polypeptide |
| 5 | 1st Polypeptide | 2nd Polypeptide | 6th Polypeptide | 5th Polypeptide | 3rd Polypeptide |
| 5 | 1st Polypeptide | 2nd Polypeptide | 6th Polypeptide | 5th Polypeptide | 4th Polypeptide |
| 5 | 1st Polypeptide | 3rd Polypeptide | 2nd Polypeptide | 4th Polypeptide | 5th Polypeptide |
| 5 | 1st Polypeptide | 3rd Polypeptide | 2nd Polypeptide | 4th Polypeptide | 6th Polypeptide |
| 5 | 1st Polypeptide | 3rd Polypeptide | 2nd Polypeptide | 5th Polypeptide | 4th Polypeptide |
| 5 | 1st Polypeptide | 3rd Polypeptide | 2nd Polypeptide | 5th Polypeptide | 6th Polypeptide |
| 5 | 1st Polypeptide | 3rd Polypeptide | 2nd Polypeptide | 6th Polypeptide | 4th Polypeptide |
| 5 | 1st Polypeptide | 3rd Polypeptide | 2nd Polypeptide | 6th Polypeptide | 5th Polypeptide |
| 5 | 1st Polypeptide | 3rd Polypeptide | 4th Polypeptide | 2nd Polypeptide | 5th Polypeptide |
| 5 | 1st Polypeptide | 3rd Polypeptide | 4th Polypeptide | 2nd Polypeptide | 6th Polypeptide |
| 5 | 1st Polypeptide | 3rd Polypeptide | 4th Polypeptide | 5th Polypeptide | 2nd Polypeptide |
| 5 | 1st Polypeptide | 3rd Polypeptide | 4th Polypeptide | 5th Polypeptide | 6th Polypeptide |
| 5 | 1st Polypeptide | 3rd Polypeptide | 4th Polypeptide | 6th Polypeptide | 2nd Polypeptide |
| 5 | 1st Polypeptide | 3rd Polypeptide | 4th Polypeptide | 6th Polypeptide | 5th Polypeptide |

-continued

| n | X₁ | X₂ | X₃ | X₄ | X₅ |
|---|---|---|---|---|---|
| 5 | 1st Polypeptide | 3rd Polypeptide | 5th Polypeptide | 2nd Polypeptide | 4th Polypeptide |
| 5 | 1st Polypeptide | 3rd Polypeptide | 5th Polypeptide | 2nd Polypeptide | 6th Polypeptide |
| 5 | 1st Polypeptide | 3rd Polypeptide | 5th Polypeptide | 4th Polypeptide | 2nd Polypeptide |
| 5 | 1st Polypeptide | 3rd Polypeptide | 5th Polypeptide | 4th Polypeptide | 6th Polypeptide |
| 5 | 1st Polypeptide | 3rd Polypeptide | 5th Polypeptide | 6th Polypeptide | 2nd Polypeptide |
| 5 | 1st Polypeptide | 3rd Polypeptide | 5th Polypeptide | 6th Polypeptide | 4th Polypeptide |
| 5 | 1st Polypeptide | 3rd Polypeptide | 6th Polypeptide | 2nd Polypeptide | 4th Polypeptide |
| 5 | 1st Polypeptide | 3rd Polypeptide | 6th Polypeptide | 2nd Polypeptide | 5th Polypeptide |
| 5 | 1st Polypeptide | 3rd Polypeptide | 6th Polypeptide | 4th Polypeptide | 2nd Polypeptide |
| 5 | 1st Polypeptide | 3rd Polypeptide | 6th Polypeptide | 4th Polypeptide | 5th Polypeptide |
| 5 | 1st Polypeptide | 3rd Polypeptide | 6th Polypeptide | 5th Polypeptide | 2nd Polypeptide |
| 5 | 1st Polypeptide | 3rd Polypeptide | 6th Polypeptide | 5th Polypeptide | 4th Polypeptide |
| 5 | 1st Polypeptide | 4th Polypeptide | 2nd Polypeptide | 3rd Polypeptide | 5th Polypeptide |
| 5 | 1st Polypeptide | 4th Polypeptide | 2nd Polypeptide | 3rd Polypeptide | 6th Polypeptide |
| 5 | 1st Polypeptide | 4th Polypeptide | 2nd Polypeptide | 5th Polypeptide | 3rd Polypeptide |
| 5 | 1st Polypeptide | 4th Polypeptide | 2nd Polypeptide | 5th Polypeptide | 6th Polypeptide |
| 5 | 1st Polypeptide | 4th Polypeptide | 2nd Polypeptide | 6th Polypeptide | 3rd Polypeptide |
| 5 | 1st Polypeptide | 4th Polypeptide | 2nd Polypeptide | 6th Polypeptide | 5th Polypeptide |
| 5 | 1st Polypeptide | 4th Polypeptide | 3rd Polypeptide | 2nd Polypeptide | 5th Polypeptide |
| 5 | 1st Polypeptide | 4th Polypeptide | 3rd Polypeptide | 2nd Polypeptide | 6th Polypeptide |
| 5 | 1st Polypeptide | 4th Polypeptide | 3rd Polypeptide | 5th Polypeptide | 2nd Polypeptide |
| 5 | 1st Polypeptide | 4th Polypeptide | 3rd Polypeptide | 5th Polypeptide | 6th Polypeptide |
| 5 | 1st Polypeptide | 4th Polypeptide | 3rd Polypeptide | 6th Polypeptide | 2nd Polypeptide |
| 5 | 1st Polypeptide | 4th Polypeptide | 3rd Polypeptide | 6th Polypeptide | 5th Polypeptide |
| 5 | 1st Polypeptide | 4th Polypeptide | 5th Polypeptide | 2nd Polypeptide | 3rd Polypeptide |
| 5 | 1st Polypeptide | 4th Polypeptide | 5th Polypeptide | 2nd Polypeptide | 6th Polypeptide |
| 5 | 1st Polypeptide | 4th Polypeptide | 5th Polypeptide | 3rd Polypeptide | 2nd Polypeptide |
| 5 | 1st Polypeptide | 4th Polypeptide | 5th Polypeptide | 3rd Polypeptide | 6th Polypeptide |
| 5 | 1st Polypeptide | 4th Polypeptide | 5th Polypeptide | 6th Polypeptide | 2nd Polypeptide |
| 5 | 1st Polypeptide | 4th Polypeptide | 5th Polypeptide | 6th Polypeptide | 3rd Polypeptide |
| 5 | 1st Polypeptide | 4th Polypeptide | 6th Polypeptide | 2nd Polypeptide | 3rd Polypeptide |
| 5 | 1st Polypeptide | 4th Polypeptide | 6th Polypeptide | 2nd Polypeptide | 5th Polypeptide |
| 5 | 1st Polypeptide | 4th Polypeptide | 6th Polypeptide | 3rd Polypeptide | 2nd Polypeptide |
| 5 | 1st Polypeptide | 4th Polypeptide | 6th Polypeptide | 3rd Polypeptide | 5th Polypeptide |
| 5 | 1st Polypeptide | 4th Polypeptide | 6th Polypeptide | 5th Polypeptide | 2nd Polypeptide |
| 5 | 1st Polypeptide | 4th Polypeptide | 6th Polypeptide | 5th Polypeptide | 3rd Polypeptide |
| 5 | 1st Polypeptide | 5th Polypeptide | 2nd Polypeptide | 3rd Polypeptide | 4th Polypeptide |
| 5 | 1st Polypeptide | 5th Polypeptide | 2nd Polypeptide | 3rd Polypeptide | 6th Polypeptide |
| 5 | 1st Polypeptide | 5th Polypeptide | 2nd Polypeptide | 4th Polypeptide | 3rd Polypeptide |
| 5 | 1st Polypeptide | 5th Polypeptide | 2nd Polypeptide | 4th Polypeptide | 6th Polypeptide |
| 5 | 1st Polypeptide | 5th Polypeptide | 2nd Polypeptide | 6th Polypeptide | 3rd Polypeptide |
| 5 | 1st Polypeptide | 5th Polypeptide | 2nd Polypeptide | 6th Polypeptide | 4th Polypeptide |
| 5 | 1st Polypeptide | 5th Polypeptide | 3rd Polypeptide | 2nd Polypeptide | 4th Polypeptide |
| 5 | 1st Polypeptide | 5th Polypeptide | 3rd Polypeptide | 2nd Polypeptide | 6th Polypeptide |
| 5 | 1st Polypeptide | 5th Polypeptide | 3rd Polypeptide | 4th Polypeptide | 2nd Polypeptide |
| 5 | 1st Polypeptide | 5th Polypeptide | 3rd Polypeptide | 4th Polypeptide | 6th Polypeptide |
| 5 | 1st Polypeptide | 5th Polypeptide | 3rd Polypeptide | 6th Polypeptide | 2nd Polypeptide |
| 5 | 1st Polypeptide | 5th Polypeptide | 3rd Polypeptide | 6th Polypeptide | 4th Polypeptide |
| 5 | 1st Polypeptide | 5th Polypeptide | 4th Polypeptide | 2nd Polypeptide | 3rd Polypeptide |
| 5 | 1st Polypeptide | 5th Polypeptide | 4th Polypeptide | 2nd Polypeptide | 6th Polypeptide |
| 5 | 1st Polypeptide | 5th Polypeptide | 4th Polypeptide | 3rd Polypeptide | 2nd Polypeptide |
| 5 | 1st Polypeptide | 5th Polypeptide | 4th Polypeptide | 3rd Polypeptide | 6th Polypeptide |
| 5 | 1st Polypeptide | 5th Polypeptide | 4th Polypeptide | 6th Polypeptide | 2nd Polypeptide |
| 5 | 1st Polypeptide | 5th Polypeptide | 4th Polypeptide | 6th Polypeptide | 3rd Polypeptide |
| 5 | 1st Polypeptide | 5th Polypeptide | 6th Polypeptide | 2nd Polypeptide | 3rd Polypeptide |
| 5 | 1st Polypeptide | 5th Polypeptide | 6th Polypeptide | 2nd Polypeptide | 4th Polypeptide |
| 5 | 1st Polypeptide | 5th Polypeptide | 6th Polypeptide | 3rd Polypeptide | 2nd Polypeptide |
| 5 | 1st Polypeptide | 5th Polypeptide | 6th Polypeptide | 3rd Polypeptide | 4th Polypeptide |
| 5 | 1st Polypeptide | 5th Polypeptide | 6th Polypeptide | 4th Polypeptide | 2nd Polypeptide |
| 5 | 1st Polypeptide | 5th Polypeptide | 6th Polypeptide | 4th Polypeptide | 3rd Polypeptide |
| 5 | 1st Polypeptide | 6th Polypeptide | 2nd Polypeptide | 3rd Polypeptide | 4th Polypeptide |
| 5 | 1st Polypeptide | 6th Polypeptide | 2nd Polypeptide | 3rd Polypeptide | 5th Polypeptide |
| 5 | 1st Polypeptide | 6th Polypeptide | 2nd Polypeptide | 4th Polypeptide | 3rd Polypeptide |
| 5 | 1st Polypeptide | 6th Polypeptide | 2nd Polypeptide | 4th Polypeptide | 5th Polypeptide |
| 5 | 1st Polypeptide | 6th Polypeptide | 2nd Polypeptide | 5th Polypeptide | 3rd Polypeptide |
| 5 | 1st Polypeptide | 6th Polypeptide | 2nd Polypeptide | 5th Polypeptide | 4th Polypeptide |
| 5 | 1st Polypeptide | 6th Polypeptide | 3rd Polypeptide | 2nd Polypeptide | 4th Polypeptide |
| 5 | 1st Polypeptide | 6th Polypeptide | 3rd Polypeptide | 2nd Polypeptide | 5th Polypeptide |
| 5 | 1st Polypeptide | 6th Polypeptide | 3rd Polypeptide | 4th Polypeptide | 2nd Polypeptide |
| 5 | 1st Polypeptide | 6th Polypeptide | 3rd Polypeptide | 4th Polypeptide | 5th Polypeptide |
| 5 | 1st Polypeptide | 6th Polypeptide | 3rd Polypeptide | 5th Polypeptide | 2nd Polypeptide |
| 5 | 1st Polypeptide | 6th Polypeptide | 3rd Polypeptide | 5th Polypeptide | 4th Polypeptide |
| 5 | 1st Polypeptide | 6th Polypeptide | 4th Polypeptide | 2nd Polypeptide | 3rd Polypeptide |
| 5 | 1st Polypeptide | 6th Polypeptide | 4th Polypeptide | 2nd Polypeptide | 5th Polypeptide |
| 5 | 1st Polypeptide | 6th Polypeptide | 4th Polypeptide | 3rd Polypeptide | 2nd Polypeptide |
| 5 | 1st Polypeptide | 6th Polypeptide | 4th Polypeptide | 3rd Polypeptide | 5th Polypeptide |
| 5 | 1st Polypeptide | 6th Polypeptide | 4th Polypeptide | 5th Polypeptide | 2nd Polypeptide |

-continued

| n | X₁ | X₂ | X₃ | X₄ | X₅ |
|---|---|---|---|---|---|
| 5 | 1st Polypeptide | 6th Polypeptide | 4th Polypeptide | 5th Polypeptide | 3rd Polypeptide |
| 5 | 1st Polypeptide | 6th Polypeptide | 5th Polypeptide | 2nd Polypeptide | 3rd Polypeptide |
| 5 | 1st Polypeptide | 6th Polypeptide | 5th Polypeptide | 2nd Polypeptide | 4th Polypeptide |
| 5 | 1st Polypeptide | 6th Polypeptide | 5th Polypeptide | 3rd Polypeptide | 2nd Polypeptide |
| 5 | 1st Polypeptide | 6th Polypeptide | 5th Polypeptide | 3rd Polypeptide | 4th Polypeptide |
| 5 | 1st Polypeptide | 6th Polypeptide | 5th Polypeptide | 4th Polypeptide | 2nd Polypeptide |
| 5 | 1st Polypeptide | 6th Polypeptide | 5th Polypeptide | 4th Polypeptide | 3rd Polypeptide |
| 5 | 2nd Polypeptide | 1st Polypeptide | 3rd Polypeptide | 4th Polypeptide | 5th Polypeptide |
| 5 | 2nd Polypeptide | 1st Polypeptide | 3rd Polypeptide | 4th Polypeptide | 6th Polypeptide |
| 5 | 2nd Polypeptide | 1st Polypeptide | 3rd Polypeptide | 5th Polypeptide | 4th Polypeptide |
| 5 | 2nd Polypeptide | 1st Polypeptide | 3rd Polypeptide | 5th Polypeptide | 6th Polypeptide |
| 5 | 2nd Polypeptide | 1st Polypeptide | 3rd Polypeptide | 6th Polypeptide | 4th Polypeptide |
| 5 | 2nd Polypeptide | 1st Polypeptide | 3rd Polypeptide | 6th Polypeptide | 5th Polypeptide |
| 5 | 2nd Polypeptide | 1st Polypeptide | 4th Polypeptide | 3rd Polypeptide | 5th Polypeptide |
| 5 | 2nd Polypeptide | 1st Polypeptide | 4th Polypeptide | 3rd Polypeptide | 6th Polypeptide |
| 5 | 2nd Polypeptide | 1st Polypeptide | 4th Polypeptide | 5th Polypeptide | 3rd Polypeptide |
| 5 | 2nd Polypeptide | 1st Polypeptide | 4th Polypeptide | 5th Polypeptide | 6th Polypeptide |
| 5 | 2nd Polypeptide | 1st Polypeptide | 4th Polypeptide | 6th Polypeptide | 3rd Polypeptide |
| 5 | 2nd Polypeptide | 1st Polypeptide | 4th Polypeptide | 6th Polypeptide | 5th Polypeptide |
| 5 | 2nd Polypeptide | 1st Polypeptide | 5th Polypeptide | 3rd Polypeptide | 4th Polypeptide |
| 5 | 2nd Polypeptide | 1st Polypeptide | 5th Polypeptide | 3rd Polypeptide | 6th Polypeptide |
| 5 | 2nd Polypeptide | 1st Polypeptide | 5th Polypeptide | 4th Polypeptide | 3rd Polypeptide |
| 5 | 2nd Polypeptide | 1st Polypeptide | 5th Polypeptide | 4th Polypeptide | 6th Polypeptide |
| 5 | 2nd Polypeptide | 1st Polypeptide | 5th Polypeptide | 6th Polypeptide | 3rd Polypeptide |
| 5 | 2nd Polypeptide | 1st Polypeptide | 5th Polypeptide | 6th Polypeptide | 4th Polypeptide |
| 5 | 2nd Polypeptide | 1st Polypeptide | 6th Polypeptide | 3rd Polypeptide | 4th Polypeptide |
| 5 | 2nd Polypeptide | 1st Polypeptide | 6th Polypeptide | 3rd Polypeptide | 5th Polypeptide |
| 5 | 2nd Polypeptide | 1st Polypeptide | 6th Polypeptide | 4th Polypeptide | 3rd Polypeptide |
| 5 | 2nd Polypeptide | 1st Polypeptide | 6th Polypeptide | 4th Polypeptide | 5th Polypeptide |
| 5 | 2nd Polypeptide | 1st Polypeptide | 6th Polypeptide | 5th Polypeptide | 3rd Polypeptide |
| 5 | 2nd Polypeptide | 1st Polypeptide | 6th Polypeptide | 5th Polypeptide | 4th Polypeptide |
| 5 | 2nd Polypeptide | 3rd Polypeptide | 1st Polypeptide | 4th Polypeptide | 5th Polypeptide |
| 5 | 2nd Polypeptide | 3rd Polypeptide | 1st Polypeptide | 4th Polypeptide | 6th Polypeptide |
| 5 | 2nd Polypeptide | 3rd Polypeptide | 1st Polypeptide | 5th Polypeptide | 4th Polypeptide |
| 5 | 2nd Polypeptide | 3rd Polypeptide | 1st Polypeptide | 5th Polypeptide | 6th Polypeptide |
| 5 | 2nd Polypeptide | 3rd Polypeptide | 1st Polypeptide | 6th Polypeptide | 4th Polypeptide |
| 5 | 2nd Polypeptide | 3rd Polypeptide | 1st Polypeptide | 6th Polypeptide | 5th Polypeptide |
| 5 | 2nd Polypeptide | 3rd Polypeptide | 4th Polypeptide | 1st Polypeptide | 5th Polypeptide |
| 5 | 2nd Polypeptide | 3rd Polypeptide | 4th Polypeptide | 1st Polypeptide | 6th Polypeptide |
| 5 | 2nd Polypeptide | 3rd Polypeptide | 4th Polypeptide | 5th Polypeptide | 1st Polypeptide |
| 5 | 2nd Polypeptide | 3rd Polypeptide | 4th Polypeptide | 5th Polypeptide | 6th Polypeptide |
| 5 | 2nd Polypeptide | 3rd Polypeptide | 4th Polypeptide | 6th Polypeptide | 1st Polypeptide |
| 5 | 2nd Polypeptide | 3rd Polypeptide | 4th Polypeptide | 6th Polypeptide | 5th Polypeptide |
| 5 | 2nd Polypeptide | 3rd Polypeptide | 5th Polypeptide | 1st Polypeptide | 4th Polypeptide |
| 5 | 2nd Polypeptide | 3rd Polypeptide | 5th Polypeptide | 1st Polypeptide | 6th Polypeptide |
| 5 | 2nd Polypeptide | 3rd Polypeptide | 5th Polypeptide | 4th Polypeptide | 1st Polypeptide |
| 5 | 2nd Polypeptide | 3rd Polypeptide | 5th Polypeptide | 4th Polypeptide | 6th Polypeptide |
| 5 | 2nd Polypeptide | 3rd Polypeptide | 5th Polypeptide | 6th Polypeptide | 1st Polypeptide |
| 5 | 2nd Polypeptide | 3rd Polypeptide | 5th Polypeptide | 6th Polypeptide | 4th Polypeptide |
| 5 | 2nd Polypeptide | 3rd Polypeptide | 6th Polypeptide | 1st Polypeptide | 4th Polypeptide |
| 5 | 2nd Polypeptide | 3rd Polypeptide | 6th Polypeptide | 1st Polypeptide | 5th Polypeptide |
| 5 | 2nd Polypeptide | 3rd Polypeptide | 6th Polypeptide | 4th Polypeptide | 1st Polypeptide |
| 5 | 2nd Polypeptide | 3rd Polypeptide | 6th Polypeptide | 4th Polypeptide | 5th Polypeptide |
| 5 | 2nd Polypeptide | 3rd Polypeptide | 6th Polypeptide | 5th Polypeptide | 1st Polypeptide |
| 5 | 2nd Polypeptide | 3rd Polypeptide | 6th Polypeptide | 5th Polypeptide | 4th Polypeptide |
| 5 | 2nd Polypeptide | 4th Polypeptide | 1st Polypeptide | 3rd Polypeptide | 5th Polypeptide |
| 5 | 2nd Polypeptide | 4th Polypeptide | 1st Polypeptide | 3rd Polypeptide | 6th Polypeptide |
| 5 | 2nd Polypeptide | 4th Polypeptide | 1st Polypeptide | 5th Polypeptide | 3rd Polypeptide |
| 5 | 2nd Polypeptide | 4th Polypeptide | 1st Polypeptide | 5th Polypeptide | 6th Polypeptide |
| 5 | 2nd Polypeptide | 4th Polypeptide | 1st Polypeptide | 6th Polypeptide | 3rd Polypeptide |
| 5 | 2nd Polypeptide | 4th Polypeptide | 1st Polypeptide | 6th Polypeptide | 5th Polypeptide |
| 5 | 2nd Polypeptide | 4th Polypeptide | 3rd Polypeptide | 1st Polypeptide | 5th Polypeptide |
| 5 | 2nd Polypeptide | 4th Polypeptide | 3rd Polypeptide | 1st Polypeptide | 6th Polypeptide |
| 5 | 2nd Polypeptide | 4th Polypeptide | 3rd Polypeptide | 5th Polypeptide | 1st Polypeptide |
| 5 | 2nd Polypeptide | 4th Polypeptide | 3rd Polypeptide | 5th Polypeptide | 6th Polypeptide |
| 5 | 2nd Polypeptide | 4th Polypeptide | 3rd Polypeptide | 6th Polypeptide | 1st Polypeptide |
| 5 | 2nd Polypeptide | 4th Polypeptide | 3rd Polypeptide | 6th Polypeptide | 5th Polypeptide |
| 5 | 2nd Polypeptide | 4th Polypeptide | 5th Polypeptide | 1st Polypeptide | 3rd Polypeptide |
| 5 | 2nd Polypeptide | 4th Polypeptide | 5th Polypeptide | 1st Polypeptide | 6th Polypeptide |
| 5 | 2nd Polypeptide | 4th Polypeptide | 5th Polypeptide | 3rd Polypeptide | 1st Polypeptide |
| 5 | 2nd Polypeptide | 4th Polypeptide | 5th Polypeptide | 3rd Polypeptide | 6th Polypeptide |
| 5 | 2nd Polypeptide | 4th Polypeptide | 5th Polypeptide | 6th Polypeptide | 1st Polypeptide |
| 5 | 2nd Polypeptide | 4th Polypeptide | 5th Polypeptide | 6th Polypeptide | 3rd Polypeptide |
| 5 | 2nd Polypeptide | 4th Polypeptide | 6th Polypeptide | 1st Polypeptide | 3rd Polypeptide |
| 5 | 2nd Polypeptide | 4th Polypeptide | 6th Polypeptide | 1st Polypeptide | 5th Polypeptide |
| 5 | 2nd Polypeptide | 4th Polypeptide | 6th Polypeptide | 3rd Polypeptide | 1st Polypeptide |
| 5 | 2nd Polypeptide | 4th Polypeptide | 6th Polypeptide | 3rd Polypeptide | 5th Polypeptide |

-continued

| n | X₁ | X₂ | X₃ | X₄ | X₅ |
|---|---|---|---|---|---|
| 5 | 2nd Polypeptide | 4th Polypeptide | 6th Polypeptide | 5th Polypeptide | 1st Polypeptide |
| 5 | 2nd Polypeptide | 4th Polypeptide | 6th Polypeptide | 5th Polypeptide | 3rd Polypeptide |
| 5 | 2nd Polypeptide | 5th Polypeptide | 1st Polypeptide | 3rd Polypeptide | 4th Polypeptide |
| 5 | 2nd Polypeptide | 5th Polypeptide | 1st Polypeptide | 3rd Polypeptide | 6th Polypeptide |
| 5 | 2nd Polypeptide | 5th Polypeptide | 1st Polypeptide | 4th Polypeptide | 3rd Polypeptide |
| 5 | 2nd Polypeptide | 5th Polypeptide | 1st Polypeptide | 4th Polypeptide | 6th Polypeptide |
| 5 | 2nd Polypeptide | 5th Polypeptide | 1st Polypeptide | 6th Polypeptide | 3rd Polypeptide |
| 5 | 2nd Polypeptide | 5th Polypeptide | 1st Polypeptide | 6th Polypeptide | 4th Polypeptide |
| 5 | 2nd Polypeptide | 5th Polypeptide | 3rd Polypeptide | 1st Polypeptide | 4th Polypeptide |
| 5 | 2nd Polypeptide | 5th Polypeptide | 3rd Polypeptide | 1st Polypeptide | 6th Polypeptide |
| 5 | 2nd Polypeptide | 5th Polypeptide | 3rd Polypeptide | 4th Polypeptide | 1st Polypeptide |
| 5 | 2nd Polypeptide | 5th Polypeptide | 3rd Polypeptide | 4th Polypeptide | 6th Polypeptide |
| 5 | 2nd Polypeptide | 5th Polypeptide | 3rd Polypeptide | 6th Polypeptide | 1st Polypeptide |
| 5 | 2nd Polypeptide | 5th Polypeptide | 3rd Polypeptide | 6th Polypeptide | 4th Polypeptide |
| 5 | 2nd Polypeptide | 5th Polypeptide | 4th Polypeptide | 1st Polypeptide | 3rd Polypeptide |
| 5 | 2nd Polypeptide | 5th Polypeptide | 4th Polypeptide | 1st Polypeptide | 6th Polypeptide |
| 5 | 2nd Polypeptide | 5th Polypeptide | 4th Polypeptide | 3rd Polypeptide | 1st Polypeptide |
| 5 | 2nd Polypeptide | 5th Polypeptide | 4th Polypeptide | 3rd Polypeptide | 6th Polypeptide |
| 5 | 2nd Polypeptide | 5th Polypeptide | 4th Polypeptide | 6th Polypeptide | 1st Polypeptide |
| 5 | 2nd Polypeptide | 5th Polypeptide | 4th Polypeptide | 6th Polypeptide | 3rd Polypeptide |
| 5 | 2nd Polypeptide | 5th Polypeptide | 6th Polypeptide | 1st Polypeptide | 3rd Polypeptide |
| 5 | 2nd Polypeptide | 5th Polypeptide | 6th Polypeptide | 1st Polypeptide | 4th Polypeptide |
| 5 | 2nd Polypeptide | 5th Polypeptide | 6th Polypeptide | 3rd Polypeptide | 1st Polypeptide |
| 5 | 2nd Polypeptide | 5th Polypeptide | 6th Polypeptide | 3rd Polypeptide | 4th Polypeptide |
| 5 | 2nd Polypeptide | 5th Polypeptide | 6th Polypeptide | 4th Polypeptide | 1st Polypeptide |
| 5 | 2nd Polypeptide | 5th Polypeptide | 6th Polypeptide | 4th Polypeptide | 3rd Polypeptide |
| 5 | 2nd Polypeptide | 6th Polypeptide | 1st Polypeptide | 3rd Polypeptide | 4th Polypeptide |
| 5 | 2nd Polypeptide | 6th Polypeptide | 1st Polypeptide | 3rd Polypeptide | 5th Polypeptide |
| 5 | 2nd Polypeptide | 6th Polypeptide | 1st Polypeptide | 4th Polypeptide | 3rd Polypeptide |
| 5 | 2nd Polypeptide | 6th Polypeptide | 1st Polypeptide | 4th Polypeptide | 5th Polypeptide |
| 5 | 2nd Polypeptide | 6th Polypeptide | 1st Polypeptide | 5th Polypeptide | 3rd Polypeptide |
| 5 | 2nd Polypeptide | 6th Polypeptide | 1st Polypeptide | 5th Polypeptide | 4th Polypeptide |
| 5 | 2nd Polypeptide | 6th Polypeptide | 3rd Polypeptide | 1st Polypeptide | 4th Polypeptide |
| 5 | 2nd Polypeptide | 6th Polypeptide | 3rd Polypeptide | 1st Polypeptide | 5th Polypeptide |
| 5 | 2nd Polypeptide | 6th Polypeptide | 3rd Polypeptide | 4th Polypeptide | 1st Polypeptide |
| 5 | 2nd Polypeptide | 6th Polypeptide | 3rd Polypeptide | 4th Polypeptide | 5th Polypeptide |
| 5 | 2nd Polypeptide | 6th Polypeptide | 3rd Polypeptide | 5th Polypeptide | 1st Polypeptide |
| 5 | 2nd Polypeptide | 6th Polypeptide | 3rd Polypeptide | 5th Polypeptide | 4th Polypeptide |
| 5 | 2nd Polypeptide | 6th Polypeptide | 4th Polypeptide | 1st Polypeptide | 3rd Polypeptide |
| 5 | 2nd Polypeptide | 6th Polypeptide | 4th Polypeptide | 1st Polypeptide | 5th Polypeptide |
| 5 | 2nd Polypeptide | 6th Polypeptide | 4th Polypeptide | 3rd Polypeptide | 1st Polypeptide |
| 5 | 2nd Polypeptide | 6th Polypeptide | 4th Polypeptide | 3rd Polypeptide | 5th Polypeptide |
| 5 | 2nd Polypeptide | 6th Polypeptide | 4th Polypeptide | 5th Polypeptide | 1st Polypeptide |
| 5 | 2nd Polypeptide | 6th Polypeptide | 4th Polypeptide | 5th Polypeptide | 3rd Polypeptide |
| 5 | 2nd Polypeptide | 6th Polypeptide | 5th Polypeptide | 1st Polypeptide | 3rd Polypeptide |
| 5 | 2nd Polypeptide | 6th Polypeptide | 5th Polypeptide | 1st Polypeptide | 4th Polypeptide |
| 5 | 2nd Polypeptide | 6th Polypeptide | 5th Polypeptide | 3rd Polypeptide | 1st Polypeptide |
| 5 | 2nd Polypeptide | 6th Polypeptide | 5th Polypeptide | 3rd Polypeptide | 4th Polypeptide |
| 5 | 2nd Polypeptide | 6th Polypeptide | 5th Polypeptide | 4th Polypeptide | 1st Polypeptide |
| 5 | 2nd Polypeptide | 6th Polypeptide | 5th Polypeptide | 4th Polypeptide | 3rd Polypeptide |
| 5 | 3rd Polypeptide | 1st Polypeptide | 2nd Polypeptide | 4th Polypeptide | 5th Polypeptide |
| 5 | 3rd Polypeptide | 1st Polypeptide | 2nd Polypeptide | 4th Polypeptide | 6th Polypeptide |
| 5 | 3rd Polypeptide | 1st Polypeptide | 2nd Polypeptide | 5th Polypeptide | 4th Polypeptide |
| 5 | 3rd Polypeptide | 1st Polypeptide | 2nd Polypeptide | 5th Polypeptide | 6th Polypeptide |
| 5 | 3rd Polypeptide | 1st Polypeptide | 2nd Polypeptide | 6th Polypeptide | 4th Polypeptide |
| 5 | 3rd Polypeptide | 1st Polypeptide | 2nd Polypeptide | 6th Polypeptide | 5th Polypeptide |
| 5 | 3rd Polypeptide | 1st Polypeptide | 4th Polypeptide | 2nd Polypeptide | 5th Polypeptide |
| 5 | 3rd Polypeptide | 1st Polypeptide | 4th Polypeptide | 2nd Polypeptide | 6th Polypeptide |
| 5 | 3rd Polypeptide | 1st Polypeptide | 4th Polypeptide | 5th Polypeptide | 2nd Polypeptide |
| 5 | 3rd Polypeptide | 1st Polypeptide | 4th Polypeptide | 5th Polypeptide | 6th Polypeptide |
| 5 | 3rd Polypeptide | 1st Polypeptide | 4th Polypeptide | 6th Polypeptide | 2nd Polypeptide |
| 5 | 3rd Polypeptide | 1st Polypeptide | 4th Polypeptide | 6th Polypeptide | 5th Polypeptide |
| 5 | 3rd Polypeptide | 1st Polypeptide | 5th Polypeptide | 2nd Polypeptide | 4th Polypeptide |
| 5 | 3rd Polypeptide | 1st Polypeptide | 5th Polypeptide | 2nd Polypeptide | 6th Polypeptide |
| 5 | 3rd Polypeptide | 1st Polypeptide | 5th Polypeptide | 4th Polypeptide | 2nd Polypeptide |
| 5 | 3rd Polypeptide | 1st Polypeptide | 5th Polypeptide | 4th Polypeptide | 6th Polypeptide |
| 5 | 3rd Polypeptide | 1st Polypeptide | 5th Polypeptide | 6th Polypeptide | 2nd Polypeptide |
| 5 | 3rd Polypeptide | 1st Polypeptide | 5th Polypeptide | 6th Polypeptide | 4th Polypeptide |
| 5 | 3rd Polypeptide | 1st Polypeptide | 6th Polypeptide | 2nd Polypeptide | 4th Polypeptide |
| 5 | 3rd Polypeptide | 1st Polypeptide | 6th Polypeptide | 2nd Polypeptide | 5th Polypeptide |
| 5 | 3rd Polypeptide | 1st Polypeptide | 6th Polypeptide | 4th Polypeptide | 2nd Polypeptide |
| 5 | 3rd Polypeptide | 1st Polypeptide | 6th Polypeptide | 4th Polypeptide | 5th Polypeptide |
| 5 | 3rd Polypeptide | 1st Polypeptide | 6th Polypeptide | 5th Polypeptide | 2nd Polypeptide |
| 5 | 3rd Polypeptide | 1st Polypeptide | 6th Polypeptide | 5th Polypeptide | 4th Polypeptide |
| 5 | 3rd Polypeptide | 2nd Polypeptide | 1st Polypeptide | 4th Polypeptide | 5th Polypeptide |
| 5 | 3rd Polypeptide | 2nd Polypeptide | 1st Polypeptide | 4th Polypeptide | 6th Polypeptide |
| 5 | 3rd Polypeptide | 2nd Polypeptide | 1st Polypeptide | 5th Polypeptide | 4th Polypeptide |

-continued

| n | X₁ | X₂ | X₃ | X₄ | X₅ |
|---|---|---|---|---|---|
| 5 | 3rd Polypeptide | 2nd Polypeptide | 1st Polypeptide | 5th Polypeptide | 6th Polypeptide |
| 5 | 3rd Polypeptide | 2nd Polypeptide | 1st Polypeptide | 6th Polypeptide | 4th Polypeptide |
| 5 | 3rd Polypeptide | 2nd Polypeptide | 1st Polypeptide | 6th Polypeptide | 5th Polypeptide |
| 5 | 3rd Polypeptide | 2nd Polypeptide | 4th Polypeptide | 1st Polypeptide | 5th Polypeptide |
| 5 | 3rd Polypeptide | 2nd Polypeptide | 4th Polypeptide | 1st Polypeptide | 6th Polypeptide |
| 5 | 3rd Polypeptide | 2nd Polypeptide | 4th Polypeptide | 5th Polypeptide | 1st Polypeptide |
| 5 | 3rd Polypeptide | 2nd Polypeptide | 4th Polypeptide | 5th Polypeptide | 6th Polypeptide |
| 5 | 3rd Polypeptide | 2nd Polypeptide | 4th Polypeptide | 6th Polypeptide | 1st Polypeptide |
| 5 | 3rd Polypeptide | 2nd Polypeptide | 4th Polypeptide | 6th Polypeptide | 5th Polypeptide |
| 5 | 3rd Polypeptide | 2nd Polypeptide | 5th Polypeptide | 1st Polypeptide | 4th Polypeptide |
| 5 | 3rd Polypeptide | 2nd Polypeptide | 5th Polypeptide | 1st Polypeptide | 6th Polypeptide |
| 5 | 3rd Polypeptide | 2nd Polypeptide | 5th Polypeptide | 4th Polypeptide | 1st Polypeptide |
| 5 | 3rd Polypeptide | 2nd Polypeptide | 5th Polypeptide | 4th Polypeptide | 6th Polypeptide |
| 5 | 3rd Polypeptide | 2nd Polypeptide | 5th Polypeptide | 6th Polypeptide | 1st Polypeptide |
| 5 | 3rd Polypeptide | 2nd Polypeptide | 5th Polypeptide | 6th Polypeptide | 4th Polypeptide |
| 5 | 3rd Polypeptide | 2nd Polypeptide | 6th Polypeptide | 1st Polypeptide | 4th Polypeptide |
| 5 | 3rd Polypeptide | 2nd Polypeptide | 6th Polypeptide | 1st Polypeptide | 5th Polypeptide |
| 5 | 3rd Polypeptide | 2nd Polypeptide | 6th Polypeptide | 4th Polypeptide | 1st Polypeptide |
| 5 | 3rd Polypeptide | 2nd Polypeptide | 6th Polypeptide | 4th Polypeptide | 5th Polypeptide |
| 5 | 3rd Polypeptide | 2nd Polypeptide | 6th Polypeptide | 5th Polypeptide | 1st Polypeptide |
| 5 | 3rd Polypeptide | 2nd Polypeptide | 6th Polypeptide | 5th Polypeptide | 4th Polypeptide |
| 5 | 3rd Polypeptide | 4th Polypeptide | 1st Polypeptide | 2nd Polypeptide | 5th Polypeptide |
| 5 | 3rd Polypeptide | 4th Polypeptide | 1st Polypeptide | 2nd Polypeptide | 6th Polypeptide |
| 5 | 3rd Polypeptide | 4th Polypeptide | 1st Polypeptide | 5th Polypeptide | 2nd Polypeptide |
| 5 | 3rd Polypeptide | 4th Polypeptide | 1st Polypeptide | 5th Polypeptide | 6th Polypeptide |
| 5 | 3rd Polypeptide | 4th Polypeptide | 1st Polypeptide | 6th Polypeptide | 2nd Polypeptide |
| 5 | 3rd Polypeptide | 4th Polypeptide | 1st Polypeptide | 6th Polypeptide | 5th Polypeptide |
| 5 | 3rd Polypeptide | 4th Polypeptide | 2nd Polypeptide | 1st Polypeptide | 5th Polypeptide |
| 5 | 3rd Polypeptide | 4th Polypeptide | 2nd Polypeptide | 1st Polypeptide | 6th Polypeptide |
| 5 | 3rd Polypeptide | 4th Polypeptide | 2nd Polypeptide | 5th Polypeptide | 1st Polypeptide |
| 5 | 3rd Polypeptide | 4th Polypeptide | 2nd Polypeptide | 5th Polypeptide | 6th Polypeptide |
| 5 | 3rd Polypeptide | 4th Polypeptide | 2nd Polypeptide | 6th Polypeptide | 1st Polypeptide |
| 5 | 3rd Polypeptide | 4th Polypeptide | 2nd Polypeptide | 6th Polypeptide | 5th Polypeptide |
| 5 | 3rd Polypeptide | 4th Polypeptide | 5th Polypeptide | 1st Polypeptide | 2nd Polypeptide |
| 5 | 3rd Polypeptide | 4th Polypeptide | 5th Polypeptide | 1st Polypeptide | 6th Polypeptide |
| 5 | 3rd Polypeptide | 4th Polypeptide | 5th Polypeptide | 2nd Polypeptide | 1st Polypeptide |
| 5 | 3rd Polypeptide | 4th Polypeptide | 5th Polypeptide | 2nd Polypeptide | 6th Polypeptide |
| 5 | 3rd Polypeptide | 4th Polypeptide | 5th Polypeptide | 6th Polypeptide | 1st Polypeptide |
| 5 | 3rd Polypeptide | 4th Polypeptide | 5th Polypeptide | 6th Polypeptide | 2nd Polypeptide |
| 5 | 3rd Polypeptide | 4th Polypeptide | 6th Polypeptide | 1st Polypeptide | 2nd Polypeptide |
| 5 | 3rd Polypeptide | 4th Polypeptide | 6th Polypeptide | 1st Polypeptide | 5th Polypeptide |
| 5 | 3rd Polypeptide | 4th Polypeptide | 6th Polypeptide | 2nd Polypeptide | 1st Polypeptide |
| 5 | 3rd Polypeptide | 4th Polypeptide | 6th Polypeptide | 2nd Polypeptide | 5th Polypeptide |
| 5 | 3rd Polypeptide | 4th Polypeptide | 6th Polypeptide | 5th Polypeptide | 1st Polypeptide |
| 5 | 3rd Polypeptide | 4th Polypeptide | 6th Polypeptide | 5th Polypeptide | 2nd Polypeptide |
| 5 | 3rd Polypeptide | 5th Polypeptide | 1st Polypeptide | 2nd Polypeptide | 4th Polypeptide |
| 5 | 3rd Polypeptide | 5th Polypeptide | 1st Polypeptide | 2nd Polypeptide | 6th Polypeptide |
| 5 | 3rd Polypeptide | 5th Polypeptide | 1st Polypeptide | 4th Polypeptide | 2nd Polypeptide |
| 5 | 3rd Polypeptide | 5th Polypeptide | 1st Polypeptide | 4th Polypeptide | 6th Polypeptide |
| 5 | 3rd Polypeptide | 5th Polypeptide | 1st Polypeptide | 6th Polypeptide | 2nd Polypeptide |
| 5 | 3rd Polypeptide | 5th Polypeptide | 1st Polypeptide | 6th Polypeptide | 4th Polypeptide |
| 5 | 3rd Polypeptide | 5th Polypeptide | 2nd Polypeptide | 1st Polypeptide | 4th Polypeptide |
| 5 | 3rd Polypeptide | 5th Polypeptide | 2nd Polypeptide | 1st Polypeptide | 6th Polypeptide |
| 5 | 3rd Polypeptide | 5th Polypeptide | 2nd Polypeptide | 4th Polypeptide | 1st Polypeptide |
| 5 | 3rd Polypeptide | 5th Polypeptide | 2nd Polypeptide | 4th Polypeptide | 6th Polypeptide |
| 5 | 3rd Polypeptide | 5th Polypeptide | 2nd Polypeptide | 6th Polypeptide | 1st Polypeptide |
| 5 | 3rd Polypeptide | 5th Polypeptide | 2nd Polypeptide | 6th Polypeptide | 4th Polypeptide |
| 5 | 3rd Polypeptide | 5th Polypeptide | 4th Polypeptide | 1st Polypeptide | 2nd Polypeptide |
| 5 | 3rd Polypeptide | 5th Polypeptide | 4th Polypeptide | 1st Polypeptide | 6th Polypeptide |
| 5 | 3rd Polypeptide | 5th Polypeptide | 4th Polypeptide | 2nd Polypeptide | 1st Polypeptide |
| 5 | 3rd Polypeptide | 5th Polypeptide | 4th Polypeptide | 2nd Polypeptide | 6th Polypeptide |
| 5 | 3rd Polypeptide | 5th Polypeptide | 4th Polypeptide | 6th Polypeptide | 1st Polypeptide |
| 5 | 3rd Polypeptide | 5th Polypeptide | 4th Polypeptide | 6th Polypeptide | 2nd Polypeptide |
| 5 | 3rd Polypeptide | 5th Polypeptide | 6th Polypeptide | 1st Polypeptide | 2nd Polypeptide |
| 5 | 3rd Polypeptide | 5th Polypeptide | 6th Polypeptide | 1st Polypeptide | 4th Polypeptide |
| 5 | 3rd Polypeptide | 5th Polypeptide | 6th Polypeptide | 2nd Polypeptide | 1st Polypeptide |
| 5 | 3rd Polypeptide | 5th Polypeptide | 6th Polypeptide | 2nd Polypeptide | 4th Polypeptide |
| 5 | 3rd Polypeptide | 5th Polypeptide | 6th Polypeptide | 4th Polypeptide | 1st Polypeptide |
| 5 | 3rd Polypeptide | 5th Polypeptide | 6th Polypeptide | 4th Polypeptide | 2nd Polypeptide |
| 5 | 3rd Polypeptide | 6th Polypeptide | 1st Polypeptide | 2nd Polypeptide | 4th Polypeptide |
| 5 | 3rd Polypeptide | 6th Polypeptide | 1st Polypeptide | 2nd Polypeptide | 5th Polypeptide |
| 5 | 3rd Polypeptide | 6th Polypeptide | 1st Polypeptide | 4th Polypeptide | 2nd Polypeptide |
| 5 | 3rd Polypeptide | 6th Polypeptide | 1st Polypeptide | 4th Polypeptide | 5th Polypeptide |
| 5 | 3rd Polypeptide | 6th Polypeptide | 1st Polypeptide | 5th Polypeptide | 2nd Polypeptide |
| 5 | 3rd Polypeptide | 6th Polypeptide | 1st Polypeptide | 5th Polypeptide | 4th Polypeptide |
| 5 | 3rd Polypeptide | 6th Polypeptide | 2nd Polypeptide | 1st Polypeptide | 4th Polypeptide |
| 5 | 3rd Polypeptide | 6th Polypeptide | 2nd Polypeptide | 1st Polypeptide | 5th Polypeptide |

-continued

| n | $X_1$ | $X_2$ | $X_3$ | $X_4$ | $X_5$ |
|---|---|---|---|---|---|
| 5 | 3rd Polypeptide | 6th Polypeptide | 2nd Polypeptide | 4th Polypeptide | 1st Polypeptide |
| 5 | 3rd Polypeptide | 6th Polypeptide | 2nd Polypeptide | 4th Polypeptide | 5th Polypeptide |
| 5 | 3rd Polypeptide | 6th Polypeptide | 2nd Polypeptide | 5th Polypeptide | 1st Polypeptide |
| 5 | 3rd Polypeptide | 6th Polypeptide | 2nd Polypeptide | 5th Polypeptide | 4th Polypeptide |
| 5 | 3rd Polypeptide | 6th Polypeptide | 4th Polypeptide | 1st Polypeptide | 2nd Polypeptide |
| 5 | 3rd Polypeptide | 6th Polypeptide | 4th Polypeptide | 1st Polypeptide | 5th Polypeptide |
| 5 | 3rd Polypeptide | 6th Polypeptide | 4th Polypeptide | 2nd Polypeptide | 1st Polypeptide |
| 5 | 3rd Polypeptide | 6th Polypeptide | 4th Polypeptide | 2nd Polypeptide | 5th Polypeptide |
| 5 | 3rd Polypeptide | 6th Polypeptide | 4th Polypeptide | 5th Polypeptide | 1st Polypeptide |
| 5 | 3rd Polypeptide | 6th Polypeptide | 4th Polypeptide | 5th Polypeptide | 2nd Polypeptide |
| 5 | 3rd Polypeptide | 6th Polypeptide | 5th Polypeptide | 1st Polypeptide | 2nd Polypeptide |
| 5 | 3rd Polypeptide | 6th Polypeptide | 5th Polypeptide | 1st Polypeptide | 4th Polypeptide |
| 5 | 3rd Polypeptide | 6th Polypeptide | 5th Polypeptide | 2nd Polypeptide | 1st Polypeptide |
| 5 | 3rd Polypeptide | 6th Polypeptide | 5th Polypeptide | 2nd Polypeptide | 4th Polypeptide |
| 5 | 3rd Polypeptide | 6th Polypeptide | 5th Polypeptide | 4th Polypeptide | 1st Polypeptide |
| 5 | 3rd Polypeptide | 6th Polypeptide | 5th Polypeptide | 4th Polypeptide | 2nd Polypeptide |
| 5 | 4th Polypeptide | 1st Polypeptide | 2nd Polypeptide | 3rd Polypeptide | 5th Polypeptide |
| 5 | 4th Polypeptide | 1st Polypeptide | 2nd Polypeptide | 3rd Polypeptide | 6th Polypeptide |
| 5 | 4th Polypeptide | 1st Polypeptide | 2nd Polypeptide | 5th Polypeptide | 3rd Polypeptide |
| 5 | 4th Polypeptide | 1st Polypeptide | 2nd Polypeptide | 5th Polypeptide | 6th Polypeptide |
| 5 | 4th Polypeptide | 1st Polypeptide | 2nd Polypeptide | 6th Polypeptide | 3rd Polypeptide |
| 5 | 4th Polypeptide | 1st Polypeptide | 2nd Polypeptide | 6th Polypeptide | 5th Polypeptide |
| 5 | 4th Polypeptide | 1st Polypeptide | 3rd Polypeptide | 2nd Polypeptide | 5th Polypeptide |
| 5 | 4th Polypeptide | 1st Polypeptide | 3rd Polypeptide | 2nd Polypeptide | 6th Polypeptide |
| 5 | 4th Polypeptide | 1st Polypeptide | 3rd Polypeptide | 5th Polypeptide | 2nd Polypeptide |
| 5 | 4th Polypeptide | 1st Polypeptide | 3rd Polypeptide | 5th Polypeptide | 6th Polypeptide |
| 5 | 4th Polypeptide | 1st Polypeptide | 3rd Polypeptide | 6th Polypeptide | 2nd Polypeptide |
| 5 | 4th Polypeptide | 1st Polypeptide | 3rd Polypeptide | 6th Polypeptide | 5th Polypeptide |
| 5 | 4th Polypeptide | 1st Polypeptide | 5th Polypeptide | 2nd Polypeptide | 3rd Polypeptide |
| 5 | 4th Polypeptide | 1st Polypeptide | 5th Polypeptide | 2nd Polypeptide | 6th Polypeptide |
| 5 | 4th Polypeptide | 1st Polypeptide | 5th Polypeptide | 3rd Polypeptide | 2nd Polypeptide |
| 5 | 4th Polypeptide | 1st Polypeptide | 5th Polypeptide | 3rd Polypeptide | 6th Polypeptide |
| 5 | 4th Polypeptide | 1st Polypeptide | 5th Polypeptide | 6th Polypeptide | 2nd Polypeptide |
| 5 | 4th Polypeptide | 1st Polypeptide | 5th Polypeptide | 6th Polypeptide | 3rd Polypeptide |
| 5 | 4th Polypeptide | 1st Polypeptide | 6th Polypeptide | 2nd Polypeptide | 3rd Polypeptide |
| 5 | 4th Polypeptide | 1st Polypeptide | 6th Polypeptide | 2nd Polypeptide | 5th Polypeptide |
| 5 | 4th Polypeptide | 1st Polypeptide | 6th Polypeptide | 3rd Polypeptide | 2nd Polypeptide |
| 5 | 4th Polypeptide | 1st Polypeptide | 6th Polypeptide | 3rd Polypeptide | 5th Polypeptide |
| 5 | 4th Polypeptide | 1st Polypeptide | 6th Polypeptide | 5th Polypeptide | 2nd Polypeptide |
| 5 | 4th Polypeptide | 1st Polypeptide | 6th Polypeptide | 5th Polypeptide | 3rd Polypeptide |
| 5 | 4th Polypeptide | 2nd Polypeptide | 1st Polypeptide | 3rd Polypeptide | 5th Polypeptide |
| 5 | 4th Polypeptide | 2nd Polypeptide | 1st Polypeptide | 3rd Polypeptide | 6th Polypeptide |
| 5 | 4th Polypeptide | 2nd Polypeptide | 1st Polypeptide | 5th Polypeptide | 3rd Polypeptide |
| 5 | 4th Polypeptide | 2nd Polypeptide | 1st Polypeptide | 5th Polypeptide | 6th Polypeptide |
| 5 | 4th Polypeptide | 2nd Polypeptide | 1st Polypeptide | 6th Polypeptide | 3rd Polypeptide |
| 5 | 4th Polypeptide | 2nd Polypeptide | 1st Polypeptide | 6th Polypeptide | 5th Polypeptide |
| 5 | 4th Polypeptide | 2nd Polypeptide | 3rd Polypeptide | 1st Polypeptide | 5th Polypeptide |
| 5 | 4th Polypeptide | 2nd Polypeptide | 3rd Polypeptide | 1st Polypeptide | 6th Polypeptide |
| 5 | 4th Polypeptide | 2nd Polypeptide | 3rd Polypeptide | 5th Polypeptide | 1st Polypeptide |
| 5 | 4th Polypeptide | 2nd Polypeptide | 3rd Polypeptide | 5th Polypeptide | 6th Polypeptide |
| 5 | 4th Polypeptide | 2nd Polypeptide | 3rd Polypeptide | 6th Polypeptide | 1st Polypeptide |
| 5 | 4th Polypeptide | 2nd Polypeptide | 3rd Polypeptide | 6th Polypeptide | 5th Polypeptide |
| 5 | 4th Polypeptide | 2nd Polypeptide | 5th Polypeptide | 1st Polypeptide | 3rd Polypeptide |
| 5 | 4th Polypeptide | 2nd Polypeptide | 5th Polypeptide | 1st Polypeptide | 6th Polypeptide |
| 5 | 4th Polypeptide | 2nd Polypeptide | 5th Polypeptide | 3rd Polypeptide | 1st Polypeptide |
| 5 | 4th Polypeptide | 2nd Polypeptide | 5th Polypeptide | 3rd Polypeptide | 6th Polypeptide |
| 5 | 4th Polypeptide | 2nd Polypeptide | 5th Polypeptide | 6th Polypeptide | 1st Polypeptide |
| 5 | 4th Polypeptide | 2nd Polypeptide | 5th Polypeptide | 6th Polypeptide | 3rd Polypeptide |
| 5 | 4th Polypeptide | 2nd Polypeptide | 6th Polypeptide | 1st Polypeptide | 3rd Polypeptide |
| 5 | 4th Polypeptide | 2nd Polypeptide | 6th Polypeptide | 1st Polypeptide | 5th Polypeptide |
| 5 | 4th Polypeptide | 2nd Polypeptide | 6th Polypeptide | 3rd Polypeptide | 1st Polypeptide |
| 5 | 4th Polypeptide | 2nd Polypeptide | 6th Polypeptide | 3rd Polypeptide | 5th Polypeptide |
| 5 | 4th Polypeptide | 2nd Polypeptide | 6th Polypeptide | 5th Polypeptide | 1st Polypeptide |
| 5 | 4th Polypeptide | 2nd Polypeptide | 6th Polypeptide | 5th Polypeptide | 3rd Polypeptide |
| 5 | 4th Polypeptide | 3rd Polypeptide | 1st Polypeptide | 2nd Polypeptide | 5th Polypeptide |
| 5 | 4th Polypeptide | 3rd Polypeptide | 1st Polypeptide | 2nd Polypeptide | 6th Polypeptide |
| 5 | 4th Polypeptide | 3rd Polypeptide | 1st Polypeptide | 5th Polypeptide | 2nd Polypeptide |
| 5 | 4th Polypeptide | 3rd Polypeptide | 1st Polypeptide | 5th Polypeptide | 6th Polypeptide |
| 5 | 4th Polypeptide | 3rd Polypeptide | 1st Polypeptide | 6th Polypeptide | 2nd Polypeptide |
| 5 | 4th Polypeptide | 3rd Polypeptide | 1st Polypeptide | 6th Polypeptide | 5th Polypeptide |
| 5 | 4th Polypeptide | 3rd Polypeptide | 2nd Polypeptide | 1st Polypeptide | 5th Polypeptide |
| 5 | 4th Polypeptide | 3rd Polypeptide | 2nd Polypeptide | 1st Polypeptide | 6th Polypeptide |
| 5 | 4th Polypeptide | 3rd Polypeptide | 2nd Polypeptide | 5th Polypeptide | 1st Polypeptide |
| 5 | 4th Polypeptide | 3rd Polypeptide | 2nd Polypeptide | 5th Polypeptide | 6th Polypeptide |
| 5 | 4th Polypeptide | 3rd Polypeptide | 2nd Polypeptide | 6th Polypeptide | 1st Polypeptide |

-continued

| n | $X_1$ | $X_2$ | $X_3$ | $X_4$ | $X_5$ |
|---|---|---|---|---|---|
| 5 | 4th Polypeptide | 3rd Polypeptide | 2nd Polypeptide | 6th Polypeptide | 5th Polypeptide |
| 5 | 4th Polypeptide | 3rd Polypeptide | 5th Polypeptide | 1st Polypeptide | 2nd Polypeptide |
| 5 | 4th Polypeptide | 3rd Polypeptide | 5th Polypeptide | 1st Polypeptide | 6th Polypeptide |
| 5 | 4th Polypeptide | 3rd Polypeptide | 5th Polypeptide | 2nd Polypeptide | 1st Polypeptide |
| 5 | 4th Polypeptide | 3rd Polypeptide | 5th Polypeptide | 2nd Polypeptide | 6th Polypeptide |
| 5 | 4th Polypeptide | 3rd Polypeptide | 5th Polypeptide | 6th Polypeptide | 1st Polypeptide |
| 5 | 4th Polypeptide | 3rd Polypeptide | 5th Polypeptide | 6th Polypeptide | 2nd Polypeptide |
| 5 | 4th Polypeptide | 3rd Polypeptide | 6th Polypeptide | 1st Polypeptide | 2nd Polypeptide |
| 5 | 4th Polypeptide | 3rd Polypeptide | 6th Polypeptide | 1st Polypeptide | 5th Polypeptide |
| 5 | 4th Polypeptide | 3rd Polypeptide | 6th Polypeptide | 2nd Polypeptide | 1st Polypeptide |
| 5 | 4th Polypeptide | 3rd Polypeptide | 6th Polypeptide | 2nd Polypeptide | 5th Polypeptide |
| 5 | 4th Polypeptide | 3rd Polypeptide | 6th Polypeptide | 5th Polypeptide | 1st Polypeptide |
| 5 | 4th Polypeptide | 3rd Polypeptide | 6th Polypeptide | 5th Polypeptide | 2nd Polypeptide |
| 5 | 4th Polypeptide | 5th Polypeptide | 1st Polypeptide | 2nd Polypeptide | 3rd Polypeptide |
| 5 | 4th Polypeptide | 5th Polypeptide | 1st Polypeptide | 2nd Polypeptide | 6th Polypeptide |
| 5 | 4th Polypeptide | 5th Polypeptide | 1st Polypeptide | 3rd Polypeptide | 2nd Polypeptide |
| 5 | 4th Polypeptide | 5th Polypeptide | 1st Polypeptide | 3rd Polypeptide | 6th Polypeptide |
| 5 | 4th Polypeptide | 5th Polypeptide | 1st Polypeptide | 6th Polypeptide | 2nd Polypeptide |
| 5 | 4th Polypeptide | 5th Polypeptide | 1st Polypeptide | 6th Polypeptide | 3rd Polypeptide |
| 5 | 4th Polypeptide | 5th Polypeptide | 2nd Polypeptide | 1st Polypeptide | 3rd Polypeptide |
| 5 | 4th Polypeptide | 5th Polypeptide | 2nd Polypeptide | 1st Polypeptide | 6th Polypeptide |
| 5 | 4th Polypeptide | 5th Polypeptide | 2nd Polypeptide | 3rd Polypeptide | 1st Polypeptide |
| 5 | 4th Polypeptide | 5th Polypeptide | 2nd Polypeptide | 3rd Polypeptide | 6th Polypeptide |
| 5 | 4th Polypeptide | 5th Polypeptide | 2nd Polypeptide | 6th Polypeptide | 1st Polypeptide |
| 5 | 4th Polypeptide | 5th Polypeptide | 2nd Polypeptide | 6th Polypeptide | 3rd Polypeptide |
| 5 | 4th Polypeptide | 5th Polypeptide | 3rd Polypeptide | 1st Polypeptide | 2nd Polypeptide |
| 5 | 4th Polypeptide | 5th Polypeptide | 3rd Polypeptide | 1st Polypeptide | 6th Polypeptide |
| 5 | 4th Polypeptide | 5th Polypeptide | 3rd Polypeptide | 2nd Polypeptide | 1st Polypeptide |
| 5 | 4th Polypeptide | 5th Polypeptide | 3rd Polypeptide | 2nd Polypeptide | 6th Polypeptide |
| 5 | 4th Polypeptide | 5th Polypeptide | 3rd Polypeptide | 6th Polypeptide | 1st Polypeptide |
| 5 | 4th Polypeptide | 5th Polypeptide | 3rd Polypeptide | 6th Polypeptide | 2nd Polypeptide |
| 5 | 4th Polypeptide | 5th Polypeptide | 6th Polypeptide | 1st Polypeptide | 2nd Polypeptide |
| 5 | 4th Polypeptide | 5th Polypeptide | 6th Polypeptide | 1st Polypeptide | 3rd Polypeptide |
| 5 | 4th Polypeptide | 5th Polypeptide | 6th Polypeptide | 2nd Polypeptide | 1st Polypeptide |
| 5 | 4th Polypeptide | 5th Polypeptide | 6th Polypeptide | 2nd Polypeptide | 3rd Polypeptide |
| 5 | 4th Polypeptide | 5th Polypeptide | 6th Polypeptide | 3rd Polypeptide | 1st Polypeptide |
| 5 | 4th Polypeptide | 5th Polypeptide | 6th Polypeptide | 3rd Polypeptide | 2nd Polypeptide |
| 5 | 4th Polypeptide | 6th Polypeptide | 1st Polypeptide | 2nd Polypeptide | 3rd Polypeptide |
| 5 | 4th Polypeptide | 6th Polypeptide | 1st Polypeptide | 2nd Polypeptide | 5th Polypeptide |
| 5 | 4th Polypeptide | 6th Polypeptide | 1st Polypeptide | 3rd Polypeptide | 2nd Polypeptide |
| 5 | 4th Polypeptide | 6th Polypeptide | 1st Polypeptide | 3rd Polypeptide | 5th Polypeptide |
| 5 | 4th Polypeptide | 6th Polypeptide | 1st Polypeptide | 5th Polypeptide | 2nd Polypeptide |
| 5 | 4th Polypeptide | 6th Polypeptide | 1st Polypeptide | 5th Polypeptide | 3rd Polypeptide |
| 5 | 4th Polypeptide | 6th Polypeptide | 2nd Polypeptide | 1st Polypeptide | 3rd Polypeptide |
| 5 | 4th Polypeptide | 6th Polypeptide | 2nd Polypeptide | 1st Polypeptide | 5th Polypeptide |
| 5 | 4th Polypeptide | 6th Polypeptide | 2nd Polypeptide | 3rd Polypeptide | 1st Polypeptide |
| 5 | 4th Polypeptide | 6th Polypeptide | 2nd Polypeptide | 3rd Polypeptide | 5th Polypeptide |
| 5 | 4th Polypeptide | 6th Polypeptide | 2nd Polypeptide | 5th Polypeptide | 1st Polypeptide |
| 5 | 4th Polypeptide | 6th Polypeptide | 2nd Polypeptide | 5th Polypeptide | 3rd Polypeptide |
| 5 | 4th Polypeptide | 6th Polypeptide | 3rd Polypeptide | 1st Polypeptide | 2nd Polypeptide |
| 5 | 4th Polypeptide | 6th Polypeptide | 3rd Polypeptide | 1st Polypeptide | 5th Polypeptide |
| 5 | 4th Polypeptide | 6th Polypeptide | 3rd Polypeptide | 2nd Polypeptide | 1st Polypeptide |
| 5 | 4th Polypeptide | 6th Polypeptide | 3rd Polypeptide | 2nd Polypeptide | 5th Polypeptide |
| 5 | 4th Polypeptide | 6th Polypeptide | 3rd Polypeptide | 5th Polypeptide | 1st Polypeptide |
| 5 | 4th Polypeptide | 6th Polypeptide | 3rd Polypeptide | 5th Polypeptide | 2nd Polypeptide |
| 5 | 4th Polypeptide | 6th Polypeptide | 5th Polypeptide | 1st Polypeptide | 2nd Polypeptide |
| 5 | 4th Polypeptide | 6th Polypeptide | 5th Polypeptide | 1st Polypeptide | 3rd Polypeptide |
| 5 | 4th Polypeptide | 6th Polypeptide | 5th Polypeptide | 2nd Polypeptide | 1st Polypeptide |
| 5 | 4th Polypeptide | 6th Polypeptide | 5th Polypeptide | 2nd Polypeptide | 3rd Polypeptide |
| 5 | 4th Polypeptide | 6th Polypeptide | 5th Polypeptide | 3rd Polypeptide | 1st Polypeptide |
| 5 | 4th Polypeptide | 6th Polypeptide | 5th Polypeptide | 3rd Polypeptide | 2nd Polypeptide |
| 5 | 5th Polypeptide | 1st Polypeptide | 2nd Polypeptide | 3rd Polypeptide | 4th Polypeptide |
| 5 | 5th Polypeptide | 1st Polypeptide | 2nd Polypeptide | 3rd Polypeptide | 6th Polypeptide |
| 5 | 5th Polypeptide | 1st Polypeptide | 2nd Polypeptide | 4th Polypeptide | 3rd Polypeptide |
| 5 | 5th Polypeptide | 1st Polypeptide | 2nd Polypeptide | 4th Polypeptide | 6th Polypeptide |
| 5 | 5th Polypeptide | 1st Polypeptide | 2nd Polypeptide | 6th Polypeptide | 3rd Polypeptide |
| 5 | 5th Polypeptide | 1st Polypeptide | 2nd Polypeptide | 6th Polypeptide | 4th Polypeptide |
| 5 | 5th Polypeptide | 1st Polypeptide | 3rd Polypeptide | 2nd Polypeptide | 4th Polypeptide |
| 5 | 5th Polypeptide | 1st Polypeptide | 3rd Polypeptide | 2nd Polypeptide | 6th Polypeptide |
| 5 | 5th Polypeptide | 1st Polypeptide | 3rd Polypeptide | 4th Polypeptide | 2nd Polypeptide |
| 5 | 5th Polypeptide | 1st Polypeptide | 3rd Polypeptide | 4th Polypeptide | 6th Polypeptide |
| 5 | 5th Polypeptide | 1st Polypeptide | 3rd Polypeptide | 6th Polypeptide | 2nd Polypeptide |
| 5 | 5th Polypeptide | 1st Polypeptide | 3rd Polypeptide | 6th Polypeptide | 4th Polypeptide |
| 5 | 5th Polypeptide | 1st Polypeptide | 4th Polypeptide | 2nd Polypeptide | 3rd Polypeptide |
| 5 | 5th Polypeptide | 1st Polypeptide | 4th Polypeptide | 2nd Polypeptide | 6th Polypeptide |

-continued

| n | X₁ | X₂ | X₃ | X₄ | X₅ |
|---|---|---|---|---|---|
| 5 | 5th Polypeptide | 1st Polypeptide | 4th Polypeptide | 3rd Polypeptide | 2nd Polypeptide |
| 5 | 5th Polypeptide | 1st Polypeptide | 4th Polypeptide | 3rd Polypeptide | 6th Polypeptide |
| 5 | 5th Polypeptide | 1st Polypeptide | 4th Polypeptide | 6th Polypeptide | 2nd Polypeptide |
| 5 | 5th Polypeptide | 1st Polypeptide | 4th Polypeptide | 6th Polypeptide | 3rd Polypeptide |
| 5 | 5th Polypeptide | 1st Polypeptide | 6th Polypeptide | 2nd Polypeptide | 3rd Polypeptide |
| 5 | 5th Polypeptide | 1st Polypeptide | 6th Polypeptide | 2nd Polypeptide | 4th Polypeptide |
| 5 | 5th Polypeptide | 1st Polypeptide | 6th Polypeptide | 3rd Polypeptide | 2nd Polypeptide |
| 5 | 5th Polypeptide | 1st Polypeptide | 6th Polypeptide | 3rd Polypeptide | 4th Polypeptide |
| 5 | 5th Polypeptide | 1st Polypeptide | 6th Polypeptide | 4th Polypeptide | 2nd Polypeptide |
| 5 | 5th Polypeptide | 1st Polypeptide | 6th Polypeptide | 4th Polypeptide | 3rd Polypeptide |
| 5 | 5th Polypeptide | 2nd Polypeptide | 1st Polypeptide | 3rd Polypeptide | 4th Polypeptide |
| 5 | 5th Polypeptide | 2nd Polypeptide | 1st Polypeptide | 3rd Polypeptide | 6th Polypeptide |
| 5 | 5th Polypeptide | 2nd Polypeptide | 1st Polypeptide | 4th Polypeptide | 3rd Polypeptide |
| 5 | 5th Polypeptide | 2nd Polypeptide | 1st Polypeptide | 4th Polypeptide | 6th Polypeptide |
| 5 | 5th Polypeptide | 2nd Polypeptide | 1st Polypeptide | 6th Polypeptide | 3rd Polypeptide |
| 5 | 5th Polypeptide | 2nd Polypeptide | 1st Polypeptide | 6th Polypeptide | 4th Polypeptide |
| 5 | 5th Polypeptide | 2nd Polypeptide | 3rd Polypeptide | 1st Polypeptide | 4th Polypeptide |
| 5 | 5th Polypeptide | 2nd Polypeptide | 3rd Polypeptide | 1st Polypeptide | 6th Polypeptide |
| 5 | 5th Polypeptide | 2nd Polypeptide | 3rd Polypeptide | 4th Polypeptide | 1st Polypeptide |
| 5 | 5th Polypeptide | 2nd Polypeptide | 3rd Polypeptide | 4th Polypeptide | 6th Polypeptide |
| 5 | 5th Polypeptide | 2nd Polypeptide | 3rd Polypeptide | 6th Polypeptide | 1st Polypeptide |
| 5 | 5th Polypeptide | 2nd Polypeptide | 3rd Polypeptide | 6th Polypeptide | 4th Polypeptide |
| 5 | 5th Polypeptide | 2nd Polypeptide | 4th Polypeptide | 1st Polypeptide | 3rd Polypeptide |
| 5 | 5th Polypeptide | 2nd Polypeptide | 4th Polypeptide | 1st Polypeptide | 6th Polypeptide |
| 5 | 5th Polypeptide | 2nd Polypeptide | 4th Polypeptide | 3rd Polypeptide | 1st Polypeptide |
| 5 | 5th Polypeptide | 2nd Polypeptide | 4th Polypeptide | 3rd Polypeptide | 6th Polypeptide |
| 5 | 5th Polypeptide | 2nd Polypeptide | 4th Polypeptide | 6th Polypeptide | 1st Polypeptide |
| 5 | 5th Polypeptide | 2nd Polypeptide | 4th Polypeptide | 6th Polypeptide | 3rd Polypeptide |
| 5 | 5th Polypeptide | 2nd Polypeptide | 6th Polypeptide | 1st Polypeptide | 3rd Polypeptide |
| 5 | 5th Polypeptide | 2nd Polypeptide | 6th Polypeptide | 1st Polypeptide | 4th Polypeptide |
| 5 | 5th Polypeptide | 2nd Polypeptide | 6th Polypeptide | 3rd Polypeptide | 1st Polypeptide |
| 5 | 5th Polypeptide | 2nd Polypeptide | 6th Polypeptide | 3rd Polypeptide | 4th Polypeptide |
| 5 | 5th Polypeptide | 2nd Polypeptide | 6th Polypeptide | 4th Polypeptide | 1st Polypeptide |
| 5 | 5th Polypeptide | 2nd Polypeptide | 6th Polypeptide | 4th Polypeptide | 3rd Polypeptide |
| 5 | 5th Polypeptide | 3rd Polypeptide | 1st Polypeptide | 2nd Polypeptide | 4th Polypeptide |
| 5 | 5th Polypeptide | 3rd Polypeptide | 1st Polypeptide | 2nd Polypeptide | 6th Polypeptide |
| 5 | 5th Polypeptide | 3rd Polypeptide | 1st Polypeptide | 4th Polypeptide | 2nd Polypeptide |
| 5 | 5th Polypeptide | 3rd Polypeptide | 1st Polypeptide | 4th Polypeptide | 6th Polypeptide |
| 5 | 5th Polypeptide | 3rd Polypeptide | 1st Polypeptide | 6th Polypeptide | 2nd Polypeptide |
| 5 | 5th Polypeptide | 3rd Polypeptide | 1st Polypeptide | 6th Polypeptide | 4th Polypeptide |
| 5 | 5th Polypeptide | 3rd Polypeptide | 2nd Polypeptide | 1st Polypeptide | 4th Polypeptide |
| 5 | 5th Polypeptide | 3rd Polypeptide | 2nd Polypeptide | 1st Polypeptide | 6th Polypeptide |
| 5 | 5th Polypeptide | 3rd Polypeptide | 2nd Polypeptide | 4th Polypeptide | 1st Polypeptide |
| 5 | 5th Polypeptide | 3rd Polypeptide | 2nd Polypeptide | 4th Polypeptide | 6th Polypeptide |
| 5 | 5th Polypeptide | 3rd Polypeptide | 2nd Polypeptide | 6th Polypeptide | 1st Polypeptide |
| 5 | 5th Polypeptide | 3rd Polypeptide | 2nd Polypeptide | 6th Polypeptide | 4th Polypeptide |
| 5 | 5th Polypeptide | 3rd Polypeptide | 4th Polypeptide | 1st Polypeptide | 2nd Polypeptide |
| 5 | 5th Polypeptide | 3rd Polypeptide | 4th Polypeptide | 1st Polypeptide | 6th Polypeptide |
| 5 | 5th Polypeptide | 3rd Polypeptide | 4th Polypeptide | 2nd Polypeptide | 1st Polypeptide |
| 5 | 5th Polypeptide | 3rd Polypeptide | 4th Polypeptide | 2nd Polypeptide | 6th Polypeptide |
| 5 | 5th Polypeptide | 3rd Polypeptide | 4th Polypeptide | 6th Polypeptide | 1st Polypeptide |
| 5 | 5th Polypeptide | 3rd Polypeptide | 4th Polypeptide | 6th Polypeptide | 2nd Polypeptide |
| 5 | 5th Polypeptide | 3rd Polypeptide | 6th Polypeptide | 1st Polypeptide | 2nd Polypeptide |
| 5 | 5th Polypeptide | 3rd Polypeptide | 6th Polypeptide | 1st Polypeptide | 4th Polypeptide |
| 5 | 5th Polypeptide | 3rd Polypeptide | 6th Polypeptide | 2nd Polypeptide | 1st Polypeptide |
| 5 | 5th Polypeptide | 3rd Polypeptide | 6th Polypeptide | 2nd Polypeptide | 4th Polypeptide |
| 5 | 5th Polypeptide | 3rd Polypeptide | 6th Polypeptide | 4th Polypeptide | 1st Polypeptide |
| 5 | 5th Polypeptide | 3rd Polypeptide | 6th Polypeptide | 4th Polypeptide | 2nd Polypeptide |
| 5 | 5th Polypeptide | 4th Polypeptide | 1st Polypeptide | 2nd Polypeptide | 3rd Polypeptide |
| 5 | 5th Polypeptide | 4th Polypeptide | 1st Polypeptide | 2nd Polypeptide | 6th Polypeptide |
| 5 | 5th Polypeptide | 4th Polypeptide | 1st Polypeptide | 3rd Polypeptide | 2nd Polypeptide |
| 5 | 5th Polypeptide | 4th Polypeptide | 1st Polypeptide | 3rd Polypeptide | 6th Polypeptide |
| 5 | 5th Polypeptide | 4th Polypeptide | 1st Polypeptide | 6th Polypeptide | 2nd Polypeptide |
| 5 | 5th Polypeptide | 4th Polypeptide | 1st Polypeptide | 6th Polypeptide | 3rd Polypeptide |
| 5 | 5th Polypeptide | 4th Polypeptide | 2nd Polypeptide | 1st Polypeptide | 3rd Polypeptide |
| 5 | 5th Polypeptide | 4th Polypeptide | 2nd Polypeptide | 1st Polypeptide | 6th Polypeptide |
| 5 | 5th Polypeptide | 4th Polypeptide | 2nd Polypeptide | 3rd Polypeptide | 1st Polypeptide |
| 5 | 5th Polypeptide | 4th Polypeptide | 2nd Polypeptide | 3rd Polypeptide | 6th Polypeptide |
| 5 | 5th Polypeptide | 4th Polypeptide | 2nd Polypeptide | 6th Polypeptide | 1st Polypeptide |
| 5 | 5th Polypeptide | 4th Polypeptide | 2nd Polypeptide | 6th Polypeptide | 3rd Polypeptide |
| 5 | 5th Polypeptide | 4th Polypeptide | 3rd Polypeptide | 1st Polypeptide | 2nd Polypeptide |
| 5 | 5th Polypeptide | 4th Polypeptide | 3rd Polypeptide | 1st Polypeptide | 6th Polypeptide |
| 5 | 5th Polypeptide | 4th Polypeptide | 3rd Polypeptide | 2nd Polypeptide | 1st Polypeptide |
| 5 | 5th Polypeptide | 4th Polypeptide | 3rd Polypeptide | 2nd Polypeptide | 6th Polypeptide |
| 5 | 5th Polypeptide | 4th Polypeptide | 3rd Polypeptide | 6th Polypeptide | 1st Polypeptide |
| 5 | 5th Polypeptide | 4th Polypeptide | 3rd Polypeptide | 6th Polypeptide | 2nd Polypeptide |
| 5 | 5th Polypeptide | 4th Polypeptide | 6th Polypeptide | 1st Polypeptide | 2nd Polypeptide |

-continued

| n | X₁ | X₂ | X₃ | X₄ | X₅ |
|---|---|---|---|---|---|
| 5 | 5th Polypeptide | 4th Polypeptide | 6th Polypeptide | 1st Polypeptide | 3rd Polypeptide |
| 5 | 5th Polypeptide | 4th Polypeptide | 6th Polypeptide | 2nd Polypeptide | 1st Polypeptide |
| 5 | 5th Polypeptide | 4th Polypeptide | 6th Polypeptide | 2nd Polypeptide | 3rd Polypeptide |
| 5 | 5th Polypeptide | 4th Polypeptide | 6th Polypeptide | 3rd Polypeptide | 1st Polypeptide |
| 5 | 5th Polypeptide | 4th Polypeptide | 6th Polypeptide | 3rd Polypeptide | 2nd Polypeptide |
| 5 | 5th Polypeptide | 6th Polypeptide | 1st Polypeptide | 2nd Polypeptide | 3rd Polypeptide |
| 5 | 5th Polypeptide | 6th Polypeptide | 1st Polypeptide | 2nd Polypeptide | 4th Polypeptide |
| 5 | 5th Polypeptide | 6th Polypeptide | 1st Polypeptide | 3rd Polypeptide | 2nd Polypeptide |
| 5 | 5th Polypeptide | 6th Polypeptide | 1st Polypeptide | 3rd Polypeptide | 4th Polypeptide |
| 5 | 5th Polypeptide | 6th Polypeptide | 1st Polypeptide | 4th Polypeptide | 2nd Polypeptide |
| 5 | 5th Polypeptide | 6th Polypeptide | 1st Polypeptide | 4th Polypeptide | 3rd Polypeptide |
| 5 | 5th Polypeptide | 6th Polypeptide | 2nd Polypeptide | 1st Polypeptide | 3rd Polypeptide |
| 5 | 5th Polypeptide | 6th Polypeptide | 2nd Polypeptide | 1st Polypeptide | 4th Polypeptide |
| 5 | 5th Polypeptide | 6th Polypeptide | 2nd Polypeptide | 3rd Polypeptide | 1st Polypeptide |
| 5 | 5th Polypeptide | 6th Polypeptide | 2nd Polypeptide | 3rd Polypeptide | 4th Polypeptide |
| 5 | 5th Polypeptide | 6th Polypeptide | 2nd Polypeptide | 4th Polypeptide | 1st Polypeptide |
| 5 | 5th Polypeptide | 6th Polypeptide | 2nd Polypeptide | 4th Polypeptide | 3rd Polypeptide |
| 5 | 5th Polypeptide | 6th Polypeptide | 3rd Polypeptide | 1st Polypeptide | 2nd Polypeptide |
| 5 | 5th Polypeptide | 6th Polypeptide | 3rd Polypeptide | 1st Polypeptide | 4th Polypeptide |
| 5 | 5th Polypeptide | 6th Polypeptide | 3rd Polypeptide | 2nd Polypeptide | 1st Polypeptide |
| 5 | 5th Polypeptide | 6th Polypeptide | 3rd Polypeptide | 2nd Polypeptide | 4th Polypeptide |
| 5 | 5th Polypeptide | 6th Polypeptide | 3rd Polypeptide | 4th Polypeptide | 1st Polypeptide |
| 5 | 5th Polypeptide | 6th Polypeptide | 3rd Polypeptide | 4th Polypeptide | 2nd Polypeptide |
| 5 | 5th Polypeptide | 6th Polypeptide | 4th Polypeptide | 1st Polypeptide | 2nd Polypeptide |
| 5 | 5th Polypeptide | 6th Polypeptide | 4th Polypeptide | 1st Polypeptide | 3rd Polypeptide |
| 5 | 5th Polypeptide | 6th Polypeptide | 4th Polypeptide | 2nd Polypeptide | 1st Polypeptide |
| 5 | 5th Polypeptide | 6th Polypeptide | 4th Polypeptide | 2nd Polypeptide | 3rd Polypeptide |
| 5 | 5th Polypeptide | 6th Polypeptide | 4th Polypeptide | 3rd Polypeptide | 1st Polypeptide |
| 5 | 5th Polypeptide | 6th Polypeptide | 4th Polypeptide | 3rd Polypeptide | 2nd Polypeptide |
| 5 | 6th Polypeptide | 1st Polypeptide | 2nd Polypeptide | 3rd Polypeptide | 4th Polypeptide |
| 5 | 6th Polypeptide | 1st Polypeptide | 2nd Polypeptide | 3rd Polypeptide | 5th Polypeptide |
| 5 | 6th Polypeptide | 1st Polypeptide | 2nd Polypeptide | 4th Polypeptide | 3rd Polypeptide |
| 5 | 6th Polypeptide | 1st Polypeptide | 2nd Polypeptide | 4th Polypeptide | 5th Polypeptide |
| 5 | 6th Polypeptide | 1st Polypeptide | 2nd Polypeptide | 5th Polypeptide | 3rd Polypeptide |
| 5 | 6th Polypeptide | 1st Polypeptide | 2nd Polypeptide | 5th Polypeptide | 4th Polypeptide |
| 5 | 6th Polypeptide | 1st Polypeptide | 3rd Polypeptide | 2nd Polypeptide | 4th Polypeptide |
| 5 | 6th Polypeptide | 1st Polypeptide | 3rd Polypeptide | 2nd Polypeptide | 5th Polypeptide |
| 5 | 6th Polypeptide | 1st Polypeptide | 3rd Polypeptide | 4th Polypeptide | 2nd Polypeptide |
| 5 | 6th Polypeptide | 1st Polypeptide | 3rd Polypeptide | 4th Polypeptide | 5th Polypeptide |
| 5 | 6th Polypeptide | 1st Polypeptide | 3rd Polypeptide | 5th Polypeptide | 2nd Polypeptide |
| 5 | 6th Polypeptide | 1st Polypeptide | 3rd Polypeptide | 5th Polypeptide | 4th Polypeptide |
| 5 | 6th Polypeptide | 1st Polypeptide | 4th Polypeptide | 2nd Polypeptide | 3rd Polypeptide |
| 5 | 6th Polypeptide | 1st Polypeptide | 4th Polypeptide | 2nd Polypeptide | 5th Polypeptide |
| 5 | 6th Polypeptide | 1st Polypeptide | 4th Polypeptide | 3rd Polypeptide | 2nd Polypeptide |
| 5 | 6th Polypeptide | 1st Polypeptide | 4th Polypeptide | 3rd Polypeptide | 5th Polypeptide |
| 5 | 6th Polypeptide | 1st Polypeptide | 4th Polypeptide | 5th Polypeptide | 2nd Polypeptide |
| 5 | 6th Polypeptide | 1st Polypeptide | 4th Polypeptide | 5th Polypeptide | 3rd Polypeptide |
| 5 | 6th Polypeptide | 1st Polypeptide | 5th Polypeptide | 2nd Polypeptide | 3rd Polypeptide |
| 5 | 6th Polypeptide | 1st Polypeptide | 5th Polypeptide | 2nd Polypeptide | 4th Polypeptide |
| 5 | 6th Polypeptide | 1st Polypeptide | 5th Polypeptide | 3rd Polypeptide | 2nd Polypeptide |
| 5 | 6th Polypeptide | 1st Polypeptide | 5th Polypeptide | 3rd Polypeptide | 4th Polypeptide |
| 5 | 6th Polypeptide | 1st Polypeptide | 5th Polypeptide | 4th Polypeptide | 2nd Polypeptide |
| 5 | 6th Polypeptide | 1st Polypeptide | 5th Polypeptide | 4th Polypeptide | 3rd Polypeptide |
| 5 | 6th Polypeptide | 2nd Polypeptide | 1st Polypeptide | 3rd Polypeptide | 4th Polypeptide |
| 5 | 6th Polypeptide | 2nd Polypeptide | 1st Polypeptide | 3rd Polypeptide | 5th Polypeptide |
| 5 | 6th Polypeptide | 2nd Polypeptide | 1st Polypeptide | 4th Polypeptide | 3rd Polypeptide |
| 5 | 6th Polypeptide | 2nd Polypeptide | 1st Polypeptide | 4th Polypeptide | 5th Polypeptide |
| 5 | 6th Polypeptide | 2nd Polypeptide | 1st Polypeptide | 5th Polypeptide | 3rd Polypeptide |
| 5 | 6th Polypeptide | 2nd Polypeptide | 1st Polypeptide | 5th Polypeptide | 4th Polypeptide |
| 5 | 6th Polypeptide | 2nd Polypeptide | 3rd Polypeptide | 1st Polypeptide | 4th Polypeptide |
| 5 | 6th Polypeptide | 2nd Polypeptide | 3rd Polypeptide | 1st Polypeptide | 5th Polypeptide |
| 5 | 6th Polypeptide | 2nd Polypeptide | 3rd Polypeptide | 4th Polypeptide | 1st Polypeptide |
| 5 | 6th Polypeptide | 2nd Polypeptide | 3rd Polypeptide | 4th Polypeptide | 5th Polypeptide |
| 5 | 6th Polypeptide | 2nd Polypeptide | 3rd Polypeptide | 5th Polypeptide | 1st Polypeptide |
| 5 | 6th Polypeptide | 2nd Polypeptide | 3rd Polypeptide | 5th Polypeptide | 4th Polypeptide |
| 5 | 6th Polypeptide | 2nd Polypeptide | 4th Polypeptide | 1st Polypeptide | 3rd Polypeptide |
| 5 | 6th Polypeptide | 2nd Polypeptide | 4th Polypeptide | 1st Polypeptide | 5th Polypeptide |
| 5 | 6th Polypeptide | 2nd Polypeptide | 4th Polypeptide | 3rd Polypeptide | 1st Polypeptide |
| 5 | 6th Polypeptide | 2nd Polypeptide | 4th Polypeptide | 3rd Polypeptide | 5th Polypeptide |
| 5 | 6th Polypeptide | 2nd Polypeptide | 4th Polypeptide | 5th Polypeptide | 1st Polypeptide |
| 5 | 6th Polypeptide | 2nd Polypeptide | 4th Polypeptide | 5th Polypeptide | 3rd Polypeptide |
| 5 | 6th Polypeptide | 2nd Polypeptide | 5th Polypeptide | 1st Polypeptide | 3rd Polypeptide |
| 5 | 6th Polypeptide | 2nd Polypeptide | 5th Polypeptide | 1st Polypeptide | 4th Polypeptide |
| 5 | 6th Polypeptide | 2nd Polypeptide | 5th Polypeptide | 3rd Polypeptide | 1st Polypeptide |
| 5 | 6th Polypeptide | 2nd Polypeptide | 5th Polypeptide | 3rd Polypeptide | 4th Polypeptide |

-continued

| n | X₁ | X₂ | X₃ | X₄ | X₅ |
|---|---|---|---|---|---|
| 5 | 6th Polypeptide | 2nd Polypeptide | 5th Polypeptide | 4th Polypeptide | 1st Polypeptide |
| 5 | 6th Polypeptide | 2nd Polypeptide | 5th Polypeptide | 4th Polypeptide | 3rd Polypeptide |
| 5 | 6th Polypeptide | 3rd Polypeptide | 1st Polypeptide | 2nd Polypeptide | 4th Polypeptide |
| 5 | 6th Polypeptide | 3rd Polypeptide | 1st Polypeptide | 2nd Polypeptide | 5th Polypeptide |
| 5 | 6th Polypeptide | 3rd Polypeptide | 1st Polypeptide | 4th Polypeptide | 2nd Polypeptide |
| 5 | 6th Polypeptide | 3rd Polypeptide | 1st Polypeptide | 4th Polypeptide | 5th Polypeptide |
| 5 | 6th Polypeptide | 3rd Polypeptide | 1st Polypeptide | 5th Polypeptide | 2nd Polypeptide |
| 5 | 6th Polypeptide | 3rd Polypeptide | 1st Polypeptide | 5th Polypeptide | 4th Polypeptide |
| 5 | 6th Polypeptide | 3rd Polypeptide | 2nd Polypeptide | 1st Polypeptide | 4th Polypeptide |
| 5 | 6th Polypeptide | 3rd Polypeptide | 2nd Polypeptide | 1st Polypeptide | 5th Polypeptide |
| 5 | 6th Polypeptide | 3rd Polypeptide | 2nd Polypeptide | 4th Polypeptide | 1st Polypeptide |
| 5 | 6th Polypeptide | 3rd Polypeptide | 2nd Polypeptide | 4th Polypeptide | 5th Polypeptide |
| 5 | 6th Polypeptide | 3rd Polypeptide | 2nd Polypeptide | 5th Polypeptide | 1st Polypeptide |
| 5 | 6th Polypeptide | 3rd Polypeptide | 2nd Polypeptide | 5th Polypeptide | 4th Polypeptide |
| 5 | 6th Polypeptide | 3rd Polypeptide | 4th Polypeptide | 1st Polypeptide | 2nd Polypeptide |
| 5 | 6th Polypeptide | 3rd Polypeptide | 4th Polypeptide | 1st Polypeptide | 5th Polypeptide |
| 5 | 6th Polypeptide | 3rd Polypeptide | 4th Polypeptide | 2nd Polypeptide | 1st Polypeptide |
| 5 | 6th Polypeptide | 3rd Polypeptide | 4th Polypeptide | 2nd Polypeptide | 5th Polypeptide |
| 5 | 6th Polypeptide | 3rd Polypeptide | 4th Polypeptide | 5th Polypeptide | 1st Polypeptide |
| 5 | 6th Polypeptide | 3rd Polypeptide | 4th Polypeptide | 5th Polypeptide | 2nd Polypeptide |
| 5 | 6th Polypeptide | 3rd Polypeptide | 5th Polypeptide | 1st Polypeptide | 2nd Polypeptide |
| 5 | 6th Polypeptide | 3rd Polypeptide | 5th Polypeptide | 1st Polypeptide | 4th Polypeptide |
| 5 | 6th Polypeptide | 3rd Polypeptide | 5th Polypeptide | 2nd Polypeptide | 1st Polypeptide |
| 5 | 6th Polypeptide | 3rd Polypeptide | 5th Polypeptide | 2nd Polypeptide | 4th Polypeptide |
| 5 | 6th Polypeptide | 3rd Polypeptide | 5th Polypeptide | 4th Polypeptide | 1st Polypeptide |
| 5 | 6th Polypeptide | 3rd Polypeptide | 5th Polypeptide | 4th Polypeptide | 2nd Polypeptide |
| 5 | 6th Polypeptide | 4th Polypeptide | 1st Polypeptide | 2nd Polypeptide | 3rd Polypeptide |
| 5 | 6th Polypeptide | 4th Polypeptide | 1st Polypeptide | 2nd Polypeptide | 5th Polypeptide |
| 5 | 6th Polypeptide | 4th Polypeptide | 1st Polypeptide | 3rd Polypeptide | 2nd Polypeptide |
| 5 | 6th Polypeptide | 4th Polypeptide | 1st Polypeptide | 3rd Polypeptide | 5th Polypeptide |
| 5 | 6th Polypeptide | 4th Polypeptide | 1st Polypeptide | 5th Polypeptide | 2nd Polypeptide |
| 5 | 6th Polypeptide | 4th Polypeptide | 1st Polypeptide | 5th Polypeptide | 3rd Polypeptide |
| 5 | 6th Polypeptide | 4th Polypeptide | 2nd Polypeptide | 1st Polypeptide | 3rd Polypeptide |
| 5 | 6th Polypeptide | 4th Polypeptide | 2nd Polypeptide | 1st Polypeptide | 5th Polypeptide |
| 5 | 6th Polypeptide | 4th Polypeptide | 2nd Polypeptide | 3rd Polypeptide | 1st Polypeptide |
| 5 | 6th Polypeptide | 4th Polypeptide | 2nd Polypeptide | 3rd Polypeptide | 5th Polypeptide |
| 5 | 6th Polypeptide | 4th Polypeptide | 2nd Polypeptide | 5th Polypeptide | 1st Polypeptide |
| 5 | 6th Polypeptide | 4th Polypeptide | 2nd Polypeptide | 5th Polypeptide | 3rd Polypeptide |
| 5 | 6th Polypeptide | 4th Polypeptide | 3rd Polypeptide | 1st Polypeptide | 2nd Polypeptide |
| 5 | 6th Polypeptide | 4th Polypeptide | 3rd Polypeptide | 1st Polypeptide | 5th Polypeptide |
| 5 | 6th Polypeptide | 4th Polypeptide | 3rd Polypeptide | 2nd Polypeptide | 1st Polypeptide |
| 5 | 6th Polypeptide | 4th Polypeptide | 3rd Polypeptide | 2nd Polypeptide | 5th Polypeptide |
| 5 | 6th Polypeptide | 4th Polypeptide | 3rd Polypeptide | 5th Polypeptide | 1st Polypeptide |
| 5 | 6th Polypeptide | 4th Polypeptide | 3rd Polypeptide | 5th Polypeptide | 2nd Polypeptide |
| 5 | 6th Polypeptide | 4th Polypeptide | 5th Polypeptide | 1st Polypeptide | 2nd Polypeptide |
| 5 | 6th Polypeptide | 4th Polypeptide | 5th Polypeptide | 1st Polypeptide | 3rd Polypeptide |
| 5 | 6th Polypeptide | 4th Polypeptide | 5th Polypeptide | 2nd Polypeptide | 1st Polypeptide |
| 5 | 6th Polypeptide | 4th Polypeptide | 5th Polypeptide | 2nd Polypeptide | 3rd Polypeptide |
| 5 | 6th Polypeptide | 4th Polypeptide | 5th Polypeptide | 3rd Polypeptide | 1st Polypeptide |
| 5 | 6th Polypeptide | 4th Polypeptide | 5th Polypeptide | 3rd Polypeptide | 2nd Polypeptide |
| 5 | 6th Polypeptide | 5th Polypeptide | 1st Polypeptide | 2nd Polypeptide | 3rd Polypeptide |
| 5 | 6th Polypeptide | 5th Polypeptide | 1st Polypeptide | 2nd Polypeptide | 4th Polypeptide |
| 5 | 6th Polypeptide | 5th Polypeptide | 1st Polypeptide | 3rd Polypeptide | 2nd Polypeptide |
| 5 | 6th Polypeptide | 5th Polypeptide | 1st Polypeptide | 3rd Polypeptide | 4th Polypeptide |
| 5 | 6th Polypeptide | 5th Polypeptide | 1st Polypeptide | 4th Polypeptide | 2nd Polypeptide |
| 5 | 6th Polypeptide | 5th Polypeptide | 1st Polypeptide | 4th Polypeptide | 3rd Polypeptide |
| 5 | 6th Polypeptide | 5th Polypeptide | 2nd Polypeptide | 1st Polypeptide | 3rd Polypeptide |
| 5 | 6th Polypeptide | 5th Polypeptide | 2nd Polypeptide | 1st Polypeptide | 4th Polypeptide |
| 5 | 6th Polypeptide | 5th Polypeptide | 2nd Polypeptide | 3rd Polypeptide | 1st Polypeptide |
| 5 | 6th Polypeptide | 5th Polypeptide | 2nd Polypeptide | 3rd Polypeptide | 4th Polypeptide |
| 5 | 6th Polypeptide | 5th Polypeptide | 2nd Polypeptide | 4th Polypeptide | 1st Polypeptide |
| 5 | 6th Polypeptide | 5th Polypeptide | 2nd Polypeptide | 4th Polypeptide | 3rd Polypeptide |
| 5 | 6th Polypeptide | 5th Polypeptide | 3rd Polypeptide | 1st Polypeptide | 2nd Polypeptide |
| 5 | 6th Polypeptide | 5th Polypeptide | 3rd Polypeptide | 1st Polypeptide | 4th Polypeptide |
| 5 | 6th Polypeptide | 5th Polypeptide | 3rd Polypeptide | 2nd Polypeptide | 1st Polypeptide |
| 5 | 6th Polypeptide | 5th Polypeptide | 3rd Polypeptide | 2nd Polypeptide | 4th Polypeptide |
| 5 | 6th Polypeptide | 5th Polypeptide | 3rd Polypeptide | 4th Polypeptide | 1st Polypeptide |
| 5 | 6th Polypeptide | 5th Polypeptide | 3rd Polypeptide | 4th Polypeptide | 2nd Polypeptide |
| 5 | 6th Polypeptide | 5th Polypeptide | 4th Polypeptide | 1st Polypeptide | 2nd Polypeptide |
| 5 | 6th Polypeptide | 5th Polypeptide | 4th Polypeptide | 1st Polypeptide | 3rd Polypeptide |
| 5 | 6th Polypeptide | 5th Polypeptide | 4th Polypeptide | 2nd Polypeptide | 1st Polypeptide |
| 5 | 6th Polypeptide | 5th Polypeptide | 4th Polypeptide | 2nd Polypeptide | 3rd Polypeptide |
| 5 | 6th Polypeptide | 5th Polypeptide | 4th Polypeptide | 3rd Polypeptide | 1st Polypeptide |
| 5 | 6th Polypeptide | 5th Polypeptide | 4th Polypeptide | 3rd Polypeptide | 2nd Polypeptide |

Where n is 6, X moieties are selected from the following:

| n | $X_1$ | $X_2$ | $X_3$ | $X_4$ | $X_5$ | $X_6$ |
|---|---|---|---|---|---|---|
| 6 | 1st Polypeptide | 2nd Polypeptide | 3rd Polypeptide | 4th Polypeptide | 5th Polypeptide | 6th Polypeptide |
| 6 | 1st Polypeptide | 2nd Polypeptide | 3rd Polypeptide | 4th Polypeptide | 6th Polypeptide | 5th Polypeptide |
| 6 | 1st Polypeptide | 2nd Polypeptide | 3rd Polypeptide | 5th Polypeptide | 4th Polypeptide | 6th Polypeptide |
| 6 | 1st Polypeptide | 2nd Polypeptide | 3rd Polypeptide | 5th Polypeptide | 6th Polypeptide | 4th Polypeptide |
| 6 | 1st Polypeptide | 2nd Polypeptide | 3rd Polypeptide | 6th Polypeptide | 4th Polypeptide | 5th Polypeptide |
| 6 | 1st Polypeptide | 2nd Polypeptide | 3rd Polypeptide | 6th Polypeptide | 5th Polypeptide | 4th Polypeptide |
| 6 | 1st Polypeptide | 2nd Polypeptide | 4th Polypeptide | 3rd Polypeptide | 5th Polypeptide | 6th Polypeptide |
| 6 | 1st Polypeptide | 2nd Polypeptide | 4th Polypeptide | 3rd Polypeptide | 6th Polypeptide | 5th Polypeptide |
| 6 | 1st Polypeptide | 2nd Polypeptide | 4th Polypeptide | 5th Polypeptide | 3rd Polypeptide | 6th Polypeptide |
| 6 | 1st Polypeptide | 2nd Polypeptide | 4th Polypeptide | 5th Polypeptide | 6th Polypeptide | 3rd Polypeptide |
| 6 | 1st Polypeptide | 2nd Polypeptide | 4th Polypeptide | 6th Polypeptide | 3rd Polypeptide | 5th Polypeptide |
| 6 | 1st Polypeptide | 2nd Polypeptide | 4th Polypeptide | 6th Polypeptide | 5th Polypeptide | 3rd Polypeptide |
| 6 | 1st Polypeptide | 2nd Polypeptide | 5th Polypeptide | 3rd Polypeptide | 4th Polypeptide | 6th Polypeptide |
| 6 | 1st Polypeptide | 2nd Polypeptide | 5th Polypeptide | 3rd Polypeptide | 6th Polypeptide | 4th Polypeptide |
| 6 | 1st Polypeptide | 2nd Polypeptide | 5th Polypeptide | 4th Polypeptide | 3rd Polypeptide | 6th Polypeptide |
| 6 | 1st Polypeptide | 2nd Polypeptide | 5th Polypeptide | 4th Polypeptide | 6th Polypeptide | 3rd Polypeptide |
| 6 | 1st Polypeptide | 2nd Polypeptide | 5th Polypeptide | 6th Polypeptide | 3rd Polypeptide | 4th Polypeptide |
| 6 | 1st Polypeptide | 2nd Polypeptide | 5th Polypeptide | 6th Polypeptide | 4th Polypeptide | 3rd Polypeptide |
| 6 | 1st Polypeptide | 2nd Polypeptide | 6th Polypeptide | 3rd Polypeptide | 4th Polypeptide | 5th Polypeptide |
| 6 | 1st Polypeptide | 2nd Polypeptide | 6th Polypeptide | 3rd Polypeptide | 5th Polypeptide | 4th Polypeptide |
| 6 | 1st Polypeptide | 2nd Polypeptide | 6th Polypeptide | 4th Polypeptide | 3rd Polypeptide | 5th Polypeptide |
| 6 | 1st Polypeptide | 2nd Polypeptide | 6th Polypeptide | 4th Polypeptide | 5th Polypeptide | 3rd Polypeptide |
| 6 | 1st Polypeptide | 2nd Polypeptide | 6th Polypeptide | 5th Polypeptide | 3rd Polypeptide | 4th Polypeptide |
| 6 | 1st Polypeptide | 2nd Polypeptide | 6th Polypeptide | 5th Polypeptide | 4th Polypeptide | 3rd Polypeptide |
| 6 | 1st Polypeptide | 3rd Polypeptide | 2nd Polypeptide | 4th Polypeptide | 5th Polypeptide | 6th Polypeptide |
| 6 | 1st Polypeptide | 3rd Polypeptide | 2nd Polypeptide | 4th Polypeptide | 6th Polypeptide | 5th Polypeptide |
| 6 | 1st Polypeptide | 3rd Polypeptide | 2nd Polypeptide | 5th Polypeptide | 4th Polypeptide | 6th Polypeptide |
| 6 | 1st Polypeptide | 3rd Polypeptide | 2nd Polypeptide | 5th Polypeptide | 6th Polypeptide | 4th Polypeptide |
| 6 | 1st Polypeptide | 3rd Polypeptide | 2nd Polypeptide | 6th Polypeptide | 4th Polypeptide | 5th Polypeptide |
| 6 | 1st Polypeptide | 3rd Polypeptide | 2nd Polypeptide | 6th Polypeptide | 5th Polypeptide | 4th Polypeptide |
| 6 | 1st Polypeptide | 3rd Polypeptide | 4th Polypeptide | 2nd Polypeptide | 5th Polypeptide | 6th Polypeptide |
| 6 | 1st Polypeptide | 3rd Polypeptide | 4th Polypeptide | 2nd Polypeptide | 6th Polypeptide | 5th Polypeptide |
| 6 | 1st Polypeptide | 3rd Polypeptide | 4th Polypeptide | 5th Polypeptide | 2nd Polypeptide | 6th Polypeptide |
| 6 | 1st Polypeptide | 3rd Polypeptide | 4th Polypeptide | 5th Polypeptide | 6th Polypeptide | 2nd Polypeptide |
| 6 | 1st Polypeptide | 3rd Polypeptide | 4th Polypeptide | 6th Polypeptide | 2nd Polypeptide | 5th Polypeptide |
| 6 | 1st Polypeptide | 3rd Polypeptide | 4th Polypeptide | 6th Polypeptide | 5th Polypeptide | 2nd Polypeptide |
| 6 | 1st Polypeptide | 3rd Polypeptide | 5th Polypeptide | 2nd Polypeptide | 4th Polypeptide | 6th Polypeptide |
| 6 | 1st Polypeptide | 3rd Polypeptide | 5th Polypeptide | 2nd Polypeptide | 6th Polypeptide | 4th Polypeptide |
| 6 | 1st Polypeptide | 3rd Polypeptide | 5th Polypeptide | 4th Polypeptide | 2nd Polypeptide | 6th Polypeptide |
| 6 | 1st Polypeptide | 3rd Polypeptide | 5th Polypeptide | 4th Polypeptide | 6th Polypeptide | 2nd Polypeptide |
| 6 | 1st Polypeptide | 3rd Polypeptide | 5th Polypeptide | 6th Polypeptide | 2nd Polypeptide | 4th Polypeptide |
| 6 | 1st Polypeptide | 3rd Polypeptide | 5th Polypeptide | 6th Polypeptide | 4th Polypeptide | 2nd Polypeptide |
| 6 | 1st Polypeptide | 3rd Polypeptide | 6th Polypeptide | 2nd Polypeptide | 4th Polypeptide | 5th Polypeptide |
| 6 | 1st Polypeptide | 3rd Polypeptide | 6th Polypeptide | 2nd Polypeptide | 5th Polypeptide | 4th Polypeptide |
| 6 | 1st Polypeptide | 3rd Polypeptide | 6th Polypeptide | 4th Polypeptide | 2nd Polypeptide | 5th Polypeptide |
| 6 | 1st Polypeptide | 3rd Polypeptide | 6th Polypeptide | 4th Polypeptide | 5th Polypeptide | 2nd Polypeptide |
| 6 | 1st Polypeptide | 3rd Polypeptide | 6th Polypeptide | 5th Polypeptide | 2nd Polypeptide | 4th Polypeptide |
| 6 | 1st Polypeptide | 3rd Polypeptide | 6th Polypeptide | 5th Polypeptide | 4th Polypeptide | 2nd Polypeptide |
| 6 | 1st Polypeptide | 4th Polypeptide | 2nd Polypeptide | 3rd Polypeptide | 5th Polypeptide | 6th Polypeptide |
| 6 | 1st Polypeptide | 4th Polypeptide | 2nd Polypeptide | 3rd Polypeptide | 6th Polypeptide | 5th Polypeptide |
| 6 | 1st Polypeptide | 4th Polypeptide | 2nd Polypeptide | 5th Polypeptide | 3rd Polypeptide | 6th Polypeptide |
| 6 | 1st Polypeptide | 4th Polypeptide | 2nd Polypeptide | 5th Polypeptide | 6th Polypeptide | 3rd Polypeptide |
| 6 | 1st Polypeptide | 4th Polypeptide | 2nd Polypeptide | 6th Polypeptide | 3rd Polypeptide | 5th Polypeptide |
| 6 | 1st Polypeptide | 4th Polypeptide | 2nd Polypeptide | 6th Polypeptide | 5th Polypeptide | 3rd Polypeptide |
| 6 | 1st Polypeptide | 4th Polypeptide | 3rd Polypeptide | 2nd Polypeptide | 5th Polypeptide | 6th Polypeptide |
| 6 | 1st Polypeptide | 4th Polypeptide | 3rd Polypeptide | 2nd Polypeptide | 6th Polypeptide | 5th Polypeptide |
| 6 | 1st Polypeptide | 4th Polypeptide | 3rd Polypeptide | 5th Polypeptide | 2nd Polypeptide | 6th Polypeptide |
| 6 | 1st Polypeptide | 4th Polypeptide | 3rd Polypeptide | 5th Polypeptide | 6th Polypeptide | 2nd Polypeptide |
| 6 | 1st Polypeptide | 4th Polypeptide | 3rd Polypeptide | 6th Polypeptide | 2nd Polypeptide | 5th Polypeptide |
| 6 | 1st Polypeptide | 4th Polypeptide | 3rd Polypeptide | 6th Polypeptide | 5th Polypeptide | 2nd Polypeptide |
| 6 | 1st Polypeptide | 4th Polypeptide | 5th Polypeptide | 2nd Polypeptide | 3rd Polypeptide | 6th Polypeptide |
| 6 | 1st Polypeptide | 4th Polypeptide | 5th Polypeptide | 2nd Polypeptide | 6th Polypeptide | 3rd Polypeptide |
| 6 | 1st Polypeptide | 4th Polypeptide | 5th Polypeptide | 3rd Polypeptide | 2nd Polypeptide | 6th Polypeptide |
| 6 | 1st Polypeptide | 4th Polypeptide | 5th Polypeptide | 3rd Polypeptide | 6th Polypeptide | 2nd Polypeptide |
| 6 | 1st Polypeptide | 4th Polypeptide | 5th Polypeptide | 6th Polypeptide | 2nd Polypeptide | 3rd Polypeptide |
| 6 | 1st Polypeptide | 4th Polypeptide | 5th Polypeptide | 6th Polypeptide | 3rd Polypeptide | 2nd Polypeptide |
| 6 | 1st Polypeptide | 4th Polypeptide | 6th Polypeptide | 2nd Polypeptide | 3rd Polypeptide | 5th Polypeptide |
| 6 | 1st Polypeptide | 4th Polypeptide | 6th Polypeptide | 2nd Polypeptide | 5th Polypeptide | 3rd Polypeptide |
| 6 | 1st Polypeptide | 4th Polypeptide | 6th Polypeptide | 3rd Polypeptide | 2nd Polypeptide | 5th Polypeptide |
| 6 | 1st Polypeptide | 4th Polypeptide | 6th Polypeptide | 3rd Polypeptide | 5th Polypeptide | 2nd Polypeptide |
| 6 | 1st Polypeptide | 4th Polypeptide | 6th Polypeptide | 5th Polypeptide | 2nd Polypeptide | 3rd Polypeptide |
| 6 | 1st Polypeptide | 4th Polypeptide | 6th Polypeptide | 5th Polypeptide | 3rd Polypeptide | 2nd Polypeptide |
| 6 | 1st Polypeptide | 5th Polypeptide | 2nd Polypeptide | 3rd Polypeptide | 4th Polypeptide | 6th Polypeptide |
| 6 | 1st Polypeptide | 5th Polypeptide | 2nd Polypeptide | 3rd Polypeptide | 6th Polypeptide | 4th Polypeptide |
| 6 | 1st Polypeptide | 5th Polypeptide | 2nd Polypeptide | 4th Polypeptide | 3rd Polypeptide | 6th Polypeptide |
| 6 | 1st Polypeptide | 5th Polypeptide | 2nd Polypeptide | 4th Polypeptide | 6th Polypeptide | 3rd Polypeptide |
| 6 | 1st Polypeptide | 5th Polypeptide | 2nd Polypeptide | 6th Polypeptide | 3rd Polypeptide | 4th Polypeptide |

-continued

| n | $X_1$ | $X_2$ | $X_3$ | $X_4$ | $X_5$ | $X_6$ |
|---|---|---|---|---|---|---|
| 6 | 1st Polypeptide | 5th Polypeptide | 2nd Polypeptide | 6th Polypeptide | 4th Polypeptide | 3rd Polypeptide |
| 6 | 1st Polypeptide | 5th Polypeptide | 3rd Polypeptide | 2nd Polypeptide | 4th Polypeptide | 6th Polypeptide |
| 6 | 1st Polypeptide | 5th Polypeptide | 3rd Polypeptide | 2nd Polypeptide | 6th Polypeptide | 4th Polypeptide |
| 6 | 1st Polypeptide | 5th Polypeptide | 3rd Polypeptide | 4th Polypeptide | 2nd Polypeptide | 6th Polypeptide |
| 6 | 1st Polypeptide | 5th Polypeptide | 3rd Polypeptide | 4th Polypeptide | 6th Polypeptide | 2nd Polypeptide |
| 6 | 1st Polypeptide | 5th Polypeptide | 3rd Polypeptide | 6th Polypeptide | 2nd Polypeptide | 4th Polypeptide |
| 6 | 1st Polypeptide | 5th Polypeptide | 3rd Polypeptide | 6th Polypeptide | 4th Polypeptide | 2nd Polypeptide |
| 6 | 1st Polypeptide | 5th Polypeptide | 4th Polypeptide | 2nd Polypeptide | 3rd Polypeptide | 6th Polypeptide |
| 6 | 1st Polypeptide | 5th Polypeptide | 4th Polypeptide | 2nd Polypeptide | 6th Polypeptide | 3rd Polypeptide |
| 6 | 1st Polypeptide | 5th Polypeptide | 4th Polypeptide | 3rd Polypeptide | 2nd Polypeptide | 6th Polypeptide |
| 6 | 1st Polypeptide | 5th Polypeptide | 4th Polypeptide | 3rd Polypeptide | 6th Polypeptide | 2nd Polypeptide |
| 6 | 1st Polypeptide | 5th Polypeptide | 4th Polypeptide | 6th Polypeptide | 2nd Polypeptide | 3rd Polypeptide |
| 6 | 1st Polypeptide | 5th Polypeptide | 4th Polypeptide | 6th Polypeptide | 3rd Polypeptide | 2nd Polypeptide |
| 6 | 1st Polypeptide | 5th Polypeptide | 6th Polypeptide | 2nd Polypeptide | 3rd Polypeptide | 4th Polypeptide |
| 6 | 1st Polypeptide | 5th Polypeptide | 6th Polypeptide | 2nd Polypeptide | 4th Polypeptide | 3rd Polypeptide |
| 6 | 1st Polypeptide | 5th Polypeptide | 6th Polypeptide | 3rd Polypeptide | 2nd Polypeptide | 4th Polypeptide |
| 6 | 1st Polypeptide | 5th Polypeptide | 6th Polypeptide | 3rd Polypeptide | 4th Polypeptide | 2nd Polypeptide |
| 6 | 1st Polypeptide | 5th Polypeptide | 6th Polypeptide | 4th Polypeptide | 2nd Polypeptide | 3rd Polypeptide |
| 6 | 1st Polypeptide | 5th Polypeptide | 6th Polypeptide | 4th Polypeptide | 3rd Polypeptide | 2nd Polypeptide |
| 6 | 1st Polypeptide | 6th Polypeptide | 2nd Polypeptide | 3rd Polypeptide | 4th Polypeptide | 5th Polypeptide |
| 6 | 1st Polypeptide | 6th Polypeptide | 2nd Polypeptide | 3rd Polypeptide | 5th Polypeptide | 4th Polypeptide |
| 6 | 1st Polypeptide | 6th Polypeptide | 2nd Polypeptide | 4th Polypeptide | 3rd Polypeptide | 5th Polypeptide |
| 6 | 1st Polypeptide | 6th Polypeptide | 2nd Polypeptide | 4th Polypeptide | 5th Polypeptide | 3rd Polypeptide |
| 6 | 1st Polypeptide | 6th Polypeptide | 2nd Polypeptide | 5th Polypeptide | 3rd Polypeptide | 4th Polypeptide |
| 6 | 1st Polypeptide | 6th Polypeptide | 2nd Polypeptide | 5th Polypeptide | 4th Polypeptide | 3rd Polypeptide |
| 6 | 1st Polypeptide | 6th Polypeptide | 3rd Polypeptide | 2nd Polypeptide | 4th Polypeptide | 5th Polypeptide |
| 6 | 1st Polypeptide | 6th Polypeptide | 3rd Polypeptide | 2nd Polypeptide | 5th Polypeptide | 4th Polypeptide |
| 6 | 1st Polypeptide | 6th Polypeptide | 3rd Polypeptide | 4th Polypeptide | 2nd Polypeptide | 5th Polypeptide |
| 6 | 1st Polypeptide | 6th Polypeptide | 3rd Polypeptide | 4th Polypeptide | 5th Polypeptide | 2nd Polypeptide |
| 6 | 1st Polypeptide | 6th Polypeptide | 3rd Polypeptide | 5th Polypeptide | 2nd Polypeptide | 4th Polypeptide |
| 6 | 1st Polypeptide | 6th Polypeptide | 3rd Polypeptide | 5th Polypeptide | 4th Polypeptide | 2nd Polypeptide |
| 6 | 1st Polypeptide | 6th Polypeptide | 4th Polypeptide | 2nd Polypeptide | 3rd Polypeptide | 5th Polypeptide |
| 6 | 1st Polypeptide | 6th Polypeptide | 4th Polypeptide | 2nd Polypeptide | 5th Polypeptide | 3rd Polypeptide |
| 6 | 1st Polypeptide | 6th Polypeptide | 4th Polypeptide | 3rd Polypeptide | 2nd Polypeptide | 5th Polypeptide |
| 6 | 1st Polypeptide | 6th Polypeptide | 4th Polypeptide | 3rd Polypeptide | 5th Polypeptide | 2nd Polypeptide |
| 6 | 1st Polypeptide | 6th Polypeptide | 4th Polypeptide | 5th Polypeptide | 2nd Polypeptide | 3rd Polypeptide |
| 6 | 1st Polypeptide | 6th Polypeptide | 4th Polypeptide | 5th Polypeptide | 3rd Polypeptide | 2nd Polypeptide |
| 6 | 1st Polypeptide | 6th Polypeptide | 5th Polypeptide | 2nd Polypeptide | 3rd Polypeptide | 4th Polypeptide |
| 6 | 1st Polypeptide | 6th Polypeptide | 5th Polypeptide | 2nd Polypeptide | 4th Polypeptide | 3rd Polypeptide |
| 6 | 1st Polypeptide | 6th Polypeptide | 5th Polypeptide | 3rd Polypeptide | 2nd Polypeptide | 4th Polypeptide |
| 6 | 1st Polypeptide | 6th Polypeptide | 5th Polypeptide | 3rd Polypeptide | 4th Polypeptide | 2nd Polypeptide |
| 6 | 1st Polypeptide | 6th Polypeptide | 5th Polypeptide | 4th Polypeptide | 2nd Polypeptide | 3rd Polypeptide |
| 6 | 1st Polypeptide | 6th Polypeptide | 5th Polypeptide | 4th Polypeptide | 3rd Polypeptide | 2nd Polypeptide |
| 6 | 2nd Polypeptide | 1st Polypeptide | 3rd Polypeptide | 4th Polypeptide | 5th Polypeptide | 6th Polypeptide |
| 6 | 2nd Polypeptide | 1st Polypeptide | 3rd Polypeptide | 4th Polypeptide | 6th Polypeptide | 5th Polypeptide |
| 6 | 2nd Polypeptide | 1st Polypeptide | 3rd Polypeptide | 5th Polypeptide | 4th Polypeptide | 6th Polypeptide |
| 6 | 2nd Polypeptide | 1st Polypeptide | 3rd Polypeptide | 5th Polypeptide | 6th Polypeptide | 4th Polypeptide |
| 6 | 2nd Polypeptide | 1st Polypeptide | 3rd Polypeptide | 6th Polypeptide | 4th Polypeptide | 5th Polypeptide |
| 6 | 2nd Polypeptide | 1st Polypeptide | 3rd Polypeptide | 6th Polypeptide | 5th Polypeptide | 4th Polypeptide |
| 6 | 2nd Polypeptide | 1st Polypeptide | 4th Polypeptide | 3rd Polypeptide | 5th Polypeptide | 6th Polypeptide |
| 6 | 2nd Polypeptide | 1st Polypeptide | 4th Polypeptide | 3rd Polypeptide | 6th Polypeptide | 5th Polypeptide |
| 6 | 2nd Polypeptide | 1st Polypeptide | 4th Polypeptide | 5th Polypeptide | 3rd Polypeptide | 6th Polypeptide |
| 6 | 2nd Polypeptide | 1st Polypeptide | 4th Polypeptide | 5th Polypeptide | 6th Polypeptide | 3rd Polypeptide |
| 6 | 2nd Polypeptide | 1st Polypeptide | 4th Polypeptide | 6th Polypeptide | 3rd Polypeptide | 5th Polypeptide |
| 6 | 2nd Polypeptide | 1st Polypeptide | 4th Polypeptide | 6th Polypeptide | 5th Polypeptide | 3rd Polypeptide |
| 6 | 2nd Polypeptide | 1st Polypeptide | 5th Polypeptide | 3rd Polypeptide | 4th Polypeptide | 6th Polypeptide |
| 6 | 2nd Polypeptide | 1st Polypeptide | 5th Polypeptide | 3rd Polypeptide | 6th Polypeptide | 4th Polypeptide |
| 6 | 2nd Polypeptide | 1st Polypeptide | 5th Polypeptide | 4th Polypeptide | 3rd Polypeptide | 6th Polypeptide |
| 6 | 2nd Polypeptide | 1st Polypeptide | 5th Polypeptide | 4th Polypeptide | 6th Polypeptide | 3rd Polypeptide |
| 6 | 2nd Polypeptide | 1st Polypeptide | 5th Polypeptide | 6th Polypeptide | 3rd Polypeptide | 4th Polypeptide |
| 6 | 2nd Polypeptide | 1st Polypeptide | 5th Polypeptide | 6th Polypeptide | 4th Polypeptide | 3rd Polypeptide |
| 6 | 2nd Polypeptide | 1st Polypeptide | 6th Polypeptide | 3rd Polypeptide | 4th Polypeptide | 5th Polypeptide |
| 6 | 2nd Polypeptide | 1st Polypeptide | 6th Polypeptide | 3rd Polypeptide | 5th Polypeptide | 4th Polypeptide |
| 6 | 2nd Polypeptide | 1st Polypeptide | 6th Polypeptide | 4th Polypeptide | 3rd Polypeptide | 5th Polypeptide |
| 6 | 2nd Polypeptide | 1st Polypeptide | 6th Polypeptide | 4th Polypeptide | 5th Polypeptide | 3rd Polypeptide |
| 6 | 2nd Polypeptide | 1st Polypeptide | 6th Polypeptide | 5th Polypeptide | 3rd Polypeptide | 4th Polypeptide |
| 6 | 2nd Polypeptide | 1st Polypeptide | 6th Polypeptide | 5th Polypeptide | 4th Polypeptide | 3rd Polypeptide |
| 6 | 2nd Polypeptide | 3rd Polypeptide | 1st Polypeptide | 4th Polypeptide | 5th Polypeptide | 6th Polypeptide |
| 6 | 2nd Polypeptide | 3rd Polypeptide | 1st Polypeptide | 4th Polypeptide | 6th Polypeptide | 5th Polypeptide |
| 6 | 2nd Polypeptide | 3rd Polypeptide | 1st Polypeptide | 5th Polypeptide | 4th Polypeptide | 6th Polypeptide |
| 6 | 2nd Polypeptide | 3rd Polypeptide | 1st Polypeptide | 5th Polypeptide | 6th Polypeptide | 4th Polypeptide |
| 6 | 2nd Polypeptide | 3rd Polypeptide | 1st Polypeptide | 6th Polypeptide | 5th Polypeptide | 4th Polypeptide |
| 6 | 2nd Polypeptide | 3rd Polypeptide | 4th Polypeptide | 1st Polypeptide | 5th Polypeptide | 6th Polypeptide |
| 6 | 2nd Polypeptide | 3rd Polypeptide | 4th Polypeptide | 1st Polypeptide | 6th Polypeptide | 5th Polypeptide |
| 6 | 2nd Polypeptide | 3rd Polypeptide | 4th Polypeptide | 5th Polypeptide | 1st Polypeptide | 6th Polypeptide |
| 6 | 2nd Polypeptide | 3rd Polypeptide | 4th Polypeptide | 5th Polypeptide | 6th Polypeptide | 1st Polypeptide |

| n | $X_1$ | $X_2$ | $X_3$ | $X_4$ | $X_5$ | $X_6$ |
|---|---|---|---|---|---|---|
| 6 | 2nd Polypeptide | 3rd Polypeptide | 4th Polypeptide | 6th Polypeptide | 1st Polypeptide | 5th Polypeptide |
| 6 | 2nd Polypeptide | 3rd Polypeptide | 4th Polypeptide | 6th Polypeptide | 5th Polypeptide | 1st Polypeptide |
| 6 | 2nd Polypeptide | 3rd Polypeptide | 5th Polypeptide | 1st Polypeptide | 4th Polypeptide | 6th Polypeptide |
| 6 | 2nd Polypeptide | 3rd Polypeptide | 5th Polypeptide | 1st Polypeptide | 6th Polypeptide | 4th Polypeptide |
| 6 | 2nd Polypeptide | 3rd Polypeptide | 5th Polypeptide | 4th Polypeptide | 1st Polypeptide | 6th Polypeptide |
| 6 | 2nd Polypeptide | 3rd Polypeptide | 5th Polypeptide | 4th Polypeptide | 6th Polypeptide | 1st Polypeptide |
| 6 | 2nd Polypeptide | 3rd Polypeptide | 5th Polypeptide | 6th Polypeptide | 1st Polypeptide | 4th Polypeptide |
| 6 | 2nd Polypeptide | 3rd Polypeptide | 5th Polypeptide | 6th Polypeptide | 4th Polypeptide | 1st Polypeptide |
| 6 | 2nd Polypeptide | 3rd Polypeptide | 6th Polypeptide | 1st Polypeptide | 4th Polypeptide | 5th Polypeptide |
| 6 | 2nd Polypeptide | 3rd Polypeptide | 6th Polypeptide | 1st Polypeptide | 5th Polypeptide | 4th Polypeptide |
| 6 | 2nd Polypeptide | 3rd Polypeptide | 6th Polypeptide | 4th Polypeptide | 1st Polypeptide | 5th Polypeptide |
| 6 | 2nd Polypeptide | 3rd Polypeptide | 6th Polypeptide | 4th Polypeptide | 5th Polypeptide | 1st Polypeptide |
| 6 | 2nd Polypeptide | 3rd Polypeptide | 6th Polypeptide | 5th Polypeptide | 1st Polypeptide | 4th Polypeptide |
| 6 | 2nd Polypeptide | 3rd Polypeptide | 6th Polypeptide | 5th Polypeptide | 4th Polypeptide | 1st Polypeptide |
| 6 | 2nd Polypeptide | 4th Polypeptide | 1st Polypeptide | 3rd Polypeptide | 5th Polypeptide | 6th Polypeptide |
| 6 | 2nd Polypeptide | 4th Polypeptide | 1st Polypeptide | 3rd Polypeptide | 6th Polypeptide | 5th Polypeptide |
| 6 | 2nd Polypeptide | 4th Polypeptide | 1st Polypeptide | 5th Polypeptide | 3rd Polypeptide | 6th Polypeptide |
| 6 | 2nd Polypeptide | 4th Polypeptide | 1st Polypeptide | 5th Polypeptide | 6th Polypeptide | 3rd Polypeptide |
| 6 | 2nd Polypeptide | 4th Polypeptide | 1st Polypeptide | 6th Polypeptide | 3rd Polypeptide | 5th Polypeptide |
| 6 | 2nd Polypeptide | 4th Polypeptide | 1st Polypeptide | 6th Polypeptide | 5th Polypeptide | 3rd Polypeptide |
| 6 | 2nd Polypeptide | 4th Polypeptide | 3rd Polypeptide | 1st Polypeptide | 5th Polypeptide | 6th Polypeptide |
| 6 | 2nd Polypeptide | 4th Polypeptide | 3rd Polypeptide | 1st Polypeptide | 6th Polypeptide | 5th Polypeptide |
| 6 | 2nd Polypeptide | 4th Polypeptide | 3rd Polypeptide | 5th Polypeptide | 1st Polypeptide | 6th Polypeptide |
| 6 | 2nd Polypeptide | 4th Polypeptide | 3rd Polypeptide | 5th Polypeptide | 6th Polypeptide | 1st Polypeptide |
| 6 | 2nd Polypeptide | 4th Polypeptide | 3rd Polypeptide | 6th Polypeptide | 1st Polypeptide | 5th Polypeptide |
| 6 | 2nd Polypeptide | 4th Polypeptide | 3rd Polypeptide | 6th Polypeptide | 5th Polypeptide | 1st Polypeptide |
| 6 | 2nd Polypeptide | 4th Polypeptide | 5th Polypeptide | 1st Polypeptide | 3rd Polypeptide | 6th Polypeptide |
| 6 | 2nd Polypeptide | 4th Polypeptide | 5th Polypeptide | 1st Polypeptide | 6th Polypeptide | 3rd Polypeptide |
| 6 | 2nd Polypeptide | 4th Polypeptide | 5th Polypeptide | 3rd Polypeptide | 1st Polypeptide | 6th Polypeptide |
| 6 | 2nd Polypeptide | 4th Polypeptide | 5th Polypeptide | 3rd Polypeptide | 6th Polypeptide | 1st Polypeptide |
| 6 | 2nd Polypeptide | 4th Polypeptide | 5th Polypeptide | 6th Polypeptide | 1st Polypeptide | 3rd Polypeptide |
| 6 | 2nd Polypeptide | 4th Polypeptide | 5th Polypeptide | 6th Polypeptide | 3rd Polypeptide | 1st Polypeptide |
| 6 | 2nd Polypeptide | 4th Polypeptide | 6th Polypeptide | 1st Polypeptide | 3rd Polypeptide | 5th Polypeptide |
| 6 | 2nd Polypeptide | 4th Polypeptide | 6th Polypeptide | 1st Polypeptide | 5th Polypeptide | 3rd Polypeptide |
| 6 | 2nd Polypeptide | 4th Polypeptide | 6th Polypeptide | 3rd Polypeptide | 1st Polypeptide | 5th Polypeptide |
| 6 | 2nd Polypeptide | 4th Polypeptide | 6th Polypeptide | 3rd Polypeptide | 5th Polypeptide | 1st Polypeptide |
| 6 | 2nd Polypeptide | 4th Polypeptide | 6th Polypeptide | 5th Polypeptide | 1st Polypeptide | 3rd Polypeptide |
| 6 | 2nd Polypeptide | 4th Polypeptide | 6th Polypeptide | 5th Polypeptide | 3rd Polypeptide | 1st Polypeptide |
| 6 | 2nd Polypeptide | 5th Polypeptide | 1st Polypeptide | 3rd Polypeptide | 4th Polypeptide | 6th Polypeptide |
| 6 | 2nd Polypeptide | 5th Polypeptide | 1st Polypeptide | 3rd Polypeptide | 6th Polypeptide | 4th Polypeptide |
| 6 | 2nd Polypeptide | 5th Polypeptide | 1st Polypeptide | 4th Polypeptide | 3rd Polypeptide | 6th Polypeptide |
| 6 | 2nd Polypeptide | 5th Polypeptide | 1st Polypeptide | 4th Polypeptide | 6th Polypeptide | 3rd Polypeptide |
| 6 | 2nd Polypeptide | 5th Polypeptide | 1st Polypeptide | 6th Polypeptide | 3rd Polypeptide | 4th Polypeptide |
| 6 | 2nd Polypeptide | 5th Polypeptide | 1st Polypeptide | 6th Polypeptide | 4th Polypeptide | 3rd Polypeptide |
| 6 | 2nd Polypeptide | 5th Polypeptide | 3rd Polypeptide | 1st Polypeptide | 4th Polypeptide | 6th Polypeptide |
| 6 | 2nd Polypeptide | 5th Polypeptide | 3rd Polypeptide | 1st Polypeptide | 6th Polypeptide | 4th Polypeptide |
| 6 | 2nd Polypeptide | 5th Polypeptide | 3rd Polypeptide | 4th Polypeptide | 1st Polypeptide | 6th Polypeptide |
| 6 | 2nd Polypeptide | 5th Polypeptide | 3rd Polypeptide | 4th Polypeptide | 6th Polypeptide | 1st Polypeptide |
| 6 | 2nd Polypeptide | 5th Polypeptide | 3rd Polypeptide | 6th Polypeptide | 1st Polypeptide | 4th Polypeptide |
| 6 | 2nd Polypeptide | 5th Polypeptide | 3rd Polypeptide | 6th Polypeptide | 4th Polypeptide | 1st Polypeptide |
| 6 | 2nd Polypeptide | 5th Polypeptide | 4th Polypeptide | 1st Polypeptide | 3rd Polypeptide | 6th Polypeptide |
| 6 | 2nd Polypeptide | 5th Polypeptide | 4th Polypeptide | 1st Polypeptide | 6th Polypeptide | 3rd Polypeptide |
| 6 | 2nd Polypeptide | 5th Polypeptide | 4th Polypeptide | 3rd Polypeptide | 1st Polypeptide | 6th Polypeptide |
| 6 | 2nd Polypeptide | 5th Polypeptide | 4th Polypeptide | 3rd Polypeptide | 6th Polypeptide | 1st Polypeptide |
| 6 | 2nd Polypeptide | 5th Polypeptide | 4th Polypeptide | 6th Polypeptide | 1st Polypeptide | 3rd Polypeptide |
| 6 | 2nd Polypeptide | 5th Polypeptide | 4th Polypeptide | 6th Polypeptide | 3rd Polypeptide | 1st Polypeptide |
| 6 | 2nd Polypeptide | 5th Polypeptide | 6th Polypeptide | 1st Polypeptide | 3rd Polypeptide | 4th Polypeptide |
| 6 | 2nd Polypeptide | 5th Polypeptide | 6th Polypeptide | 1st Polypeptide | 4th Polypeptide | 3rd Polypeptide |
| 6 | 2nd Polypeptide | 5th Polypeptide | 6th Polypeptide | 3rd Polypeptide | 1st Polypeptide | 4th Polypeptide |
| 6 | 2nd Polypeptide | 5th Polypeptide | 6th Polypeptide | 3rd Polypeptide | 4th Polypeptide | 1st Polypeptide |
| 6 | 2nd Polypeptide | 5th Polypeptide | 6th Polypeptide | 4th Polypeptide | 1st Polypeptide | 3rd Polypeptide |
| 6 | 2nd Polypeptide | 5th Polypeptide | 6th Polypeptide | 4th Polypeptide | 3rd Polypeptide | 1st Polypeptide |
| 6 | 2nd Polypeptide | 6th Polypeptide | 1st Polypeptide | 3rd Polypeptide | 4th Polypeptide | 5th Polypeptide |
| 6 | 2nd Polypeptide | 6th Polypeptide | 1st Polypeptide | 3rd Polypeptide | 5th Polypeptide | 4th Polypeptide |
| 6 | 2nd Polypeptide | 6th Polypeptide | 1st Polypeptide | 4th Polypeptide | 3rd Polypeptide | 5th Polypeptide |
| 6 | 2nd Polypeptide | 6th Polypeptide | 1st Polypeptide | 4th Polypeptide | 5th Polypeptide | 3rd Polypeptide |
| 6 | 2nd Polypeptide | 6th Polypeptide | 1st Polypeptide | 5th Polypeptide | 3rd Polypeptide | 4th Polypeptide |
| 6 | 2nd Polypeptide | 6th Polypeptide | 1st Polypeptide | 5th Polypeptide | 4th Polypeptide | 3rd Polypeptide |
| 6 | 2nd Polypeptide | 6th Polypeptide | 3rd Polypeptide | 1st Polypeptide | 4th Polypeptide | 5th Polypeptide |
| 6 | 2nd Polypeptide | 6th Polypeptide | 3rd Polypeptide | 1st Polypeptide | 5th Polypeptide | 4th Polypeptide |
| 6 | 2nd Polypeptide | 6th Polypeptide | 3rd Polypeptide | 4th Polypeptide | 1st Polypeptide | 5th Polypeptide |
| 6 | 2nd Polypeptide | 6th Polypeptide | 3rd Polypeptide | 4th Polypeptide | 5th Polypeptide | 1st Polypeptide |
| 6 | 2nd Polypeptide | 6th Polypeptide | 3rd Polypeptide | 5th Polypeptide | 1st Polypeptide | 4th Polypeptide |
| 6 | 2nd Polypeptide | 6th Polypeptide | 3rd Polypeptide | 5th Polypeptide | 4th Polypeptide | 1st Polypeptide |
| 6 | 2nd Polypeptide | 6th Polypeptide | 4th Polypeptide | 1st Polypeptide | 3rd Polypeptide | 5th Polypeptide |
| 6 | 2nd Polypeptide | 6th Polypeptide | 4th Polypeptide | 1st Polypeptide | 5th Polypeptide | 3rd Polypeptide |
| 6 | 2nd Polypeptide | 6th Polypeptide | 4th Polypeptide | 3rd Polypeptide | 1st Polypeptide | 5th Polypeptide |

-continued

| n | $X_1$ | $X_2$ | $X_3$ | $X_4$ | $X_5$ | $X_6$ |
|---|---|---|---|---|---|---|
| 6 | 2nd Polypeptide | 6th Polypeptide | 4th Polypeptide | 3rd Polypeptide | 5th Polypeptide | 1st Polypeptide |
| 6 | 2nd Polypeptide | 6th Polypeptide | 4th Polypeptide | 5th Polypeptide | 1st Polypeptide | 3rd Polypeptide |
| 6 | 2nd Polypeptide | 6th Polypeptide | 4th Polypeptide | 5th Polypeptide | 3rd Polypeptide | 1st Polypeptide |
| 6 | 2nd Polypeptide | 6th Polypeptide | 5th Polypeptide | 1st Polypeptide | 3rd Polypeptide | 4th Polypeptide |
| 6 | 2nd Polypeptide | 6th Polypeptide | 5th Polypeptide | 1st Polypeptide | 4th Polypeptide | 3rd Polypeptide |
| 6 | 2nd Polypeptide | 6th Polypeptide | 5th Polypeptide | 3rd Polypeptide | 1st Polypeptide | 4th Polypeptide |
| 6 | 2nd Polypeptide | 6th Polypeptide | 5th Polypeptide | 3rd Polypeptide | 4th Polypeptide | 1st Polypeptide |
| 6 | 2nd Polypeptide | 6th Polypeptide | 5th Polypeptide | 4th Polypeptide | 1st Polypeptide | 3rd Polypeptide |
| 6 | 2nd Polypeptide | 6th Polypeptide | 5th Polypeptide | 4th Polypeptide | 3rd Polypeptide | 1st Polypeptide |
| 6 | 3rd Polypeptide | 1st Polypeptide | 2nd Polypeptide | 4th Polypeptide | 5th Polypeptide | 6th Polypeptide |
| 6 | 3rd Polypeptide | 1st Polypeptide | 2nd Polypeptide | 4th Polypeptide | 6th Polypeptide | 5th Polypeptide |
| 6 | 3rd Polypeptide | 1st Polypeptide | 2nd Polypeptide | 5th Polypeptide | 4th Polypeptide | 6th Polypeptide |
| 6 | 3rd Polypeptide | 1st Polypeptide | 2nd Polypeptide | 5th Polypeptide | 6th Polypeptide | 4th Polypeptide |
| 6 | 3rd Polypeptide | 1st Polypeptide | 2nd Polypeptide | 6th Polypeptide | 4th Polypeptide | 5th Polypeptide |
| 6 | 3rd Polypeptide | 1st Polypeptide | 2nd Polypeptide | 6th Polypeptide | 5th Polypeptide | 4th Polypeptide |
| 6 | 3rd Polypeptide | 1st Polypeptide | 4th Polypeptide | 2nd Polypeptide | 5th Polypeptide | 6th Polypeptide |
| 6 | 3rd Polypeptide | 1st Polypeptide | 4th Polypeptide | 2nd Polypeptide | 6th Polypeptide | 5th Polypeptide |
| 6 | 3rd Polypeptide | 1st Polypeptide | 4th Polypeptide | 5th Polypeptide | 2nd Polypeptide | 6th Polypeptide |
| 6 | 3rd Polypeptide | 1st Polypeptide | 4th Polypeptide | 5th Polypeptide | 6th Polypeptide | 2nd Polypeptide |
| 6 | 3rd Polypeptide | 1st Polypeptide | 4th Polypeptide | 6th Polypeptide | 2nd Polypeptide | 5th Polypeptide |
| 6 | 3rd Polypeptide | 1st Polypeptide | 4th Polypeptide | 6th Polypeptide | 5th Polypeptide | 2nd Polypeptide |
| 6 | 3rd Polypeptide | 1st Polypeptide | 5th Polypeptide | 2nd Polypeptide | 4th Polypeptide | 6th Polypeptide |
| 6 | 3rd Polypeptide | 1st Polypeptide | 5th Polypeptide | 2nd Polypeptide | 6th Polypeptide | 4th Polypeptide |
| 6 | 3rd Polypeptide | 1st Polypeptide | 5th Polypeptide | 4th Polypeptide | 2nd Polypeptide | 6th Polypeptide |
| 6 | 3rd Polypeptide | 1st Polypeptide | 5th Polypeptide | 4th Polypeptide | 6th Polypeptide | 2nd Polypeptide |
| 6 | 3rd Polypeptide | 1st Polypeptide | 5th Polypeptide | 6th Polypeptide | 2nd Polypeptide | 4th Polypeptide |
| 6 | 3rd Polypeptide | 1st Polypeptide | 5th Polypeptide | 6th Polypeptide | 4th Polypeptide | 2nd Polypeptide |
| 6 | 3rd Polypeptide | 1st Polypeptide | 6th Polypeptide | 2nd Polypeptide | 4th Polypeptide | 5th Polypeptide |
| 6 | 3rd Polypeptide | 1st Polypeptide | 6th Polypeptide | 2nd Polypeptide | 5th Polypeptide | 4th Polypeptide |
| 6 | 3rd Polypeptide | 1st Polypeptide | 6th Polypeptide | 4th Polypeptide | 2nd Polypeptide | 5th Polypeptide |
| 6 | 3rd Polypeptide | 1st Polypeptide | 6th Polypeptide | 4th Polypeptide | 5th Polypeptide | 2nd Polypeptide |
| 6 | 3rd Polypeptide | 1st Polypeptide | 6th Polypeptide | 5th Polypeptide | 2nd Polypeptide | 4th Polypeptide |
| 6 | 3rd Polypeptide | 1st Polypeptide | 6th Polypeptide | 5th Polypeptide | 4th Polypeptide | 2nd Polypeptide |
| 6 | 3rd Polypeptide | 2nd Polypeptide | 1st Polypeptide | 4th Polypeptide | 5th Polypeptide | 6th Polypeptide |
| 6 | 3rd Polypeptide | 2nd Polypeptide | 1st Polypeptide | 4th Polypeptide | 6th Polypeptide | 5th Polypeptide |
| 6 | 3rd Polypeptide | 2nd Polypeptide | 1st Polypeptide | 5th Polypeptide | 4th Polypeptide | 6th Polypeptide |
| 6 | 3rd Polypeptide | 2nd Polypeptide | 1st Polypeptide | 5th Polypeptide | 6th Polypeptide | 4th Polypeptide |
| 6 | 3rd Polypeptide | 2nd Polypeptide | 1st Polypeptide | 6th Polypeptide | 4th Polypeptide | 5th Polypeptide |
| 6 | 3rd Polypeptide | 2nd Polypeptide | 1st Polypeptide | 6th Polypeptide | 5th Polypeptide | 4th Polypeptide |
| 6 | 3rd Polypeptide | 2nd Polypeptide | 4th Polypeptide | 1st Polypeptide | 5th Polypeptide | 6th Polypeptide |
| 6 | 3rd Polypeptide | 2nd Polypeptide | 4th Polypeptide | 1st Polypeptide | 6th Polypeptide | 5th Polypeptide |
| 6 | 3rd Polypeptide | 2nd Polypeptide | 4th Polypeptide | 5th Polypeptide | 1st Polypeptide | 6th Polypeptide |
| 6 | 3rd Polypeptide | 2nd Polypeptide | 4th Polypeptide | 5th Polypeptide | 6th Polypeptide | 1st Polypeptide |
| 6 | 3rd Polypeptide | 2nd Polypeptide | 4th Polypeptide | 6th Polypeptide | 1st Polypeptide | 5th Polypeptide |
| 6 | 3rd Polypeptide | 2nd Polypeptide | 4th Polypeptide | 6th Polypeptide | 5th Polypeptide | 1st Polypeptide |
| 6 | 3rd Polypeptide | 2nd Polypeptide | 5th Polypeptide | 1st Polypeptide | 4th Polypeptide | 6th Polypeptide |
| 6 | 3rd Polypeptide | 2nd Polypeptide | 5th Polypeptide | 1st Polypeptide | 6th Polypeptide | 4th Polypeptide |
| 6 | 3rd Polypeptide | 2nd Polypeptide | 5th Polypeptide | 4th Polypeptide | 1st Polypeptide | 6th Polypeptide |
| 6 | 3rd Polypeptide | 2nd Polypeptide | 5th Polypeptide | 4th Polypeptide | 6th Polypeptide | 1st Polypeptide |
| 6 | 3rd Polypeptide | 2nd Polypeptide | 5th Polypeptide | 6th Polypeptide | 1st Polypeptide | 4th Polypeptide |
| 6 | 3rd Polypeptide | 2nd Polypeptide | 5th Polypeptide | 6th Polypeptide | 4th Polypeptide | 1st Polypeptide |
| 6 | 3rd Polypeptide | 2nd Polypeptide | 6th Polypeptide | 1st Polypeptide | 4th Polypeptide | 5th Polypeptide |
| 6 | 3rd Polypeptide | 2nd Polypeptide | 6th Polypeptide | 1st Polypeptide | 5th Polypeptide | 4th Polypeptide |
| 6 | 3rd Polypeptide | 2nd Polypeptide | 6th Polypeptide | 4th Polypeptide | 1st Polypeptide | 5th Polypeptide |
| 6 | 3rd Polypeptide | 2nd Polypeptide | 6th Polypeptide | 4th Polypeptide | 5th Polypeptide | 1st Polypeptide |
| 6 | 3rd Polypeptide | 2nd Polypeptide | 6th Polypeptide | 5th Polypeptide | 1st Polypeptide | 4th Polypeptide |
| 6 | 3rd Polypeptide | 2nd Polypeptide | 6th Polypeptide | 5th Polypeptide | 4th Polypeptide | 1st Polypeptide |
| 6 | 3rd Polypeptide | 4th Polypeptide | 1st Polypeptide | 2nd Polypeptide | 5th Polypeptide | 6th Polypeptide |
| 6 | 3rd Polypeptide | 4th Polypeptide | 1st Polypeptide | 2nd Polypeptide | 6th Polypeptide | 5th Polypeptide |
| 6 | 3rd Polypeptide | 4th Polypeptide | 1st Polypeptide | 5th Polypeptide | 2nd Polypeptide | 6th Polypeptide |
| 6 | 3rd Polypeptide | 4th Polypeptide | 1st Polypeptide | 5th Polypeptide | 6th Polypeptide | 2nd Polypeptide |
| 6 | 3rd Polypeptide | 4th Polypeptide | 1st Polypeptide | 6th Polypeptide | 2nd Polypeptide | 5th Polypeptide |
| 6 | 3rd Polypeptide | 4th Polypeptide | 1st Polypeptide | 6th Polypeptide | 5th Polypeptide | 2nd Polypeptide |
| 6 | 3rd Polypeptide | 4th Polypeptide | 2nd Polypeptide | 1st Polypeptide | 5th Polypeptide | 6th Polypeptide |
| 6 | 3rd Polypeptide | 4th Polypeptide | 2nd Polypeptide | 1st Polypeptide | 6th Polypeptide | 5th Polypeptide |
| 6 | 3rd Polypeptide | 4th Polypeptide | 2nd Polypeptide | 5th Polypeptide | 1st Polypeptide | 6th Polypeptide |
| 6 | 3rd Polypeptide | 4th Polypeptide | 2nd Polypeptide | 5th Polypeptide | 6th Polypeptide | 1st Polypeptide |
| 6 | 3rd Polypeptide | 4th Polypeptide | 2nd Polypeptide | 6th Polypeptide | 1st Polypeptide | 5th Polypeptide |
| 6 | 3rd Polypeptide | 4th Polypeptide | 2nd Polypeptide | 6th Polypeptide | 5th Polypeptide | 1st Polypeptide |
| 6 | 3rd Polypeptide | 4th Polypeptide | 5th Polypeptide | 1st Polypeptide | 2nd Polypeptide | 6th Polypeptide |
| 6 | 3rd Polypeptide | 4th Polypeptide | 5th Polypeptide | 1st Polypeptide | 6th Polypeptide | 2nd Polypeptide |
| 6 | 3rd Polypeptide | 4th Polypeptide | 5th Polypeptide | 2nd Polypeptide | 6th Polypeptide | 1st Polypeptide |
| 6 | 3rd Polypeptide | 4th Polypeptide | 5th Polypeptide | 6th Polypeptide | 1st Polypeptide | 2nd Polypeptide |
| 6 | 3rd Polypeptide | 4th Polypeptide | 5th Polypeptide | 6th Polypeptide | 2nd Polypeptide | 1st Polypeptide |
| 6 | 3rd Polypeptide | 4th Polypeptide | 6th Polypeptide | 1st Polypeptide | 2nd Polypeptide | 5th Polypeptide |
| 6 | 3rd Polypeptide | 4th Polypeptide | 6th Polypeptide | 1st Polypeptide | 5th Polypeptide | 2nd Polypeptide |

-continued

| n | $X_1$ | $X_2$ | $X_3$ | $X_4$ | $X_5$ | $X_6$ |
|---|---|---|---|---|---|---|
| 6 | 3rd Polypeptide | 4th Polypeptide | 6th Polypeptide | 2nd Polypeptide | 1st Polypeptide | 5th Polypeptide |
| 6 | 3rd Polypeptide | 4th Polypeptide | 6th Polypeptide | 2nd Polypeptide | 5th Polypeptide | 1st Polypeptide |
| 6 | 3rd Polypeptide | 4th Polypeptide | 6th Polypeptide | 5th Polypeptide | 1st Polypeptide | 2nd Polypeptide |
| 6 | 3rd Polypeptide | 4th Polypeptide | 6th Polypeptide | 5th Polypeptide | 2nd Polypeptide | 1st Polypeptide |
| 6 | 3rd Polypeptide | 5th Polypeptide | 1st Polypeptide | 2nd Polypeptide | 4th Polypeptide | 6th Polypeptide |
| 6 | 3rd Polypeptide | 5th Polypeptide | 1st Polypeptide | 2nd Polypeptide | 6th Polypeptide | 4th Polypeptide |
| 6 | 3rd Polypeptide | 5th Polypeptide | 1st Polypeptide | 4th Polypeptide | 2nd Polypeptide | 6th Polypeptide |
| 6 | 3rd Polypeptide | 5th Polypeptide | 1st Polypeptide | 4th Polypeptide | 6th Polypeptide | 2nd Polypeptide |
| 6 | 3rd Polypeptide | 5th Polypeptide | 1st Polypeptide | 6th Polypeptide | 2nd Polypeptide | 4th Polypeptide |
| 6 | 3rd Polypeptide | 5th Polypeptide | 1st Polypeptide | 6th Polypeptide | 4th Polypeptide | 2nd Polypeptide |
| 6 | 3rd Polypeptide | 5th Polypeptide | 2nd Polypeptide | 1st Polypeptide | 4th Polypeptide | 6th Polypeptide |
| 6 | 3rd Polypeptide | 5th Polypeptide | 2nd Polypeptide | 1st Polypeptide | 6th Polypeptide | 4th Polypeptide |
| 6 | 3rd Polypeptide | 5th Polypeptide | 2nd Polypeptide | 4th Polypeptide | 1st Polypeptide | 6th Polypeptide |
| 6 | 3rd Polypeptide | 5th Polypeptide | 2nd Polypeptide | 4th Polypeptide | 6th Polypeptide | 1st Polypeptide |
| 6 | 3rd Polypeptide | 5th Polypeptide | 2nd Polypeptide | 6th Polypeptide | 1st Polypeptide | 4th Polypeptide |
| 6 | 3rd Polypeptide | 5th Polypeptide | 2nd Polypeptide | 6th Polypeptide | 4th Polypeptide | 1st Polypeptide |
| 6 | 3rd Polypeptide | 5th Polypeptide | 4th Polypeptide | 1st Polypeptide | 2nd Polypeptide | 6th Polypeptide |
| 6 | 3rd Polypeptide | 5th Polypeptide | 4th Polypeptide | 1st Polypeptide | 6th Polypeptide | 2nd Polypeptide |
| 6 | 3rd Polypeptide | 5th Polypeptide | 4th Polypeptide | 2nd Polypeptide | 1st Polypeptide | 6th Polypeptide |
| 6 | 3rd Polypeptide | 5th Polypeptide | 4th Polypeptide | 2nd Polypeptide | 6th Polypeptide | 1st Polypeptide |
| 6 | 3rd Polypeptide | 5th Polypeptide | 4th Polypeptide | 6th Polypeptide | 1st Polypeptide | 2nd Polypeptide |
| 6 | 3rd Polypeptide | 5th Polypeptide | 4th Polypeptide | 6th Polypeptide | 2nd Polypeptide | 1st Polypeptide |
| 6 | 3rd Polypeptide | 5th Polypeptide | 6th Polypeptide | 1st Polypeptide | 2nd Polypeptide | 4th Polypeptide |
| 6 | 3rd Polypeptide | 5th Polypeptide | 6th Polypeptide | 1st Polypeptide | 4th Polypeptide | 2nd Polypeptide |
| 6 | 3rd Polypeptide | 5th Polypeptide | 6th Polypeptide | 2nd Polypeptide | 1st Polypeptide | 4th Polypeptide |
| 6 | 3rd Polypeptide | 5th Polypeptide | 6th Polypeptide | 2nd Polypeptide | 4th Polypeptide | 1st Polypeptide |
| 6 | 3rd Polypeptide | 5th Polypeptide | 6th Polypeptide | 4th Polypeptide | 1st Polypeptide | 2nd Polypeptide |
| 6 | 3rd Polypeptide | 5th Polypeptide | 6th Polypeptide | 4th Polypeptide | 2nd Polypeptide | 1st Polypeptide |
| 6 | 3rd Polypeptide | 6th Polypeptide | 1st Polypeptide | 2nd Polypeptide | 4th Polypeptide | 5th Polypeptide |
| 6 | 3rd Polypeptide | 6th Polypeptide | 1st Polypeptide | 2nd Polypeptide | 5th Polypeptide | 4th Polypeptide |
| 6 | 3rd Polypeptide | 6th Polypeptide | 1st Polypeptide | 4th Polypeptide | 2nd Polypeptide | 5th Polypeptide |
| 6 | 3rd Polypeptide | 6th Polypeptide | 1st Polypeptide | 4th Polypeptide | 5th Polypeptide | 2nd Polypeptide |
| 6 | 3rd Polypeptide | 6th Polypeptide | 1st Polypeptide | 5th Polypeptide | 2nd Polypeptide | 4th Polypeptide |
| 6 | 3rd Polypeptide | 6th Polypeptide | 1st Polypeptide | 5th Polypeptide | 4th Polypeptide | 2nd Polypeptide |
| 6 | 3rd Polypeptide | 6th Polypeptide | 2nd Polypeptide | 1st Polypeptide | 4th Polypeptide | 5th Polypeptide |
| 6 | 3rd Polypeptide | 6th Polypeptide | 2nd Polypeptide | 1st Polypeptide | 5th Polypeptide | 4th Polypeptide |
| 6 | 3rd Polypeptide | 6th Polypeptide | 2nd Polypeptide | 4th Polypeptide | 1st Polypeptide | 5th Polypeptide |
| 6 | 3rd Polypeptide | 6th Polypeptide | 2nd Polypeptide | 4th Polypeptide | 5th Polypeptide | 1st Polypeptide |
| 6 | 3rd Polypeptide | 6th Polypeptide | 2nd Polypeptide | 5th Polypeptide | 1st Polypeptide | 4th Polypeptide |
| 6 | 3rd Polypeptide | 6th Polypeptide | 2nd Polypeptide | 5th Polypeptide | 4th Polypeptide | 1st Polypeptide |
| 6 | 3rd Polypeptide | 6th Polypeptide | 4th Polypeptide | 1st Polypeptide | 2nd Polypeptide | 5th Polypeptide |
| 6 | 3rd Polypeptide | 6th Polypeptide | 4th Polypeptide | 1st Polypeptide | 5th Polypeptide | 2nd Polypeptide |
| 6 | 3rd Polypeptide | 6th Polypeptide | 4th Polypeptide | 2nd Polypeptide | 1st Polypeptide | 5th Polypeptide |
| 6 | 3rd Polypeptide | 6th Polypeptide | 4th Polypeptide | 2nd Polypeptide | 5th Polypeptide | 1st Polypeptide |
| 6 | 3rd Polypeptide | 6th Polypeptide | 4th Polypeptide | 5th Polypeptide | 1st Polypeptide | 2nd Polypeptide |
| 6 | 3rd Polypeptide | 6th Polypeptide | 4th Polypeptide | 5th Polypeptide | 2nd Polypeptide | 1st Polypeptide |
| 6 | 3rd Polypeptide | 6th Polypeptide | 5th Polypeptide | 1st Polypeptide | 2nd Polypeptide | 4th Polypeptide |
| 6 | 3rd Polypeptide | 6th Polypeptide | 5th Polypeptide | 1st Polypeptide | 4th Polypeptide | 2nd Polypeptide |
| 6 | 3rd Polypeptide | 6th Polypeptide | 5th Polypeptide | 2nd Polypeptide | 1st Polypeptide | 4th Polypeptide |
| 6 | 3rd Polypeptide | 6th Polypeptide | 5th Polypeptide | 2nd Polypeptide | 4th Polypeptide | 1st Polypeptide |
| 6 | 3rd Polypeptide | 6th Polypeptide | 5th Polypeptide | 4th Polypeptide | 1st Polypeptide | 2nd Polypeptide |
| 6 | 3rd Polypeptide | 6th Polypeptide | 5th Polypeptide | 4th Polypeptide | 2nd Polypeptide | 1st Polypeptide |
| 6 | 4th Polypeptide | 1st Polypeptide | 2nd Polypeptide | 3rd Polypeptide | 5th Polypeptide | 6th Polypeptide |
| 6 | 4th Polypeptide | 1st Polypeptide | 2nd Polypeptide | 3rd Polypeptide | 6th Polypeptide | 5th Polypeptide |
| 6 | 4th Polypeptide | 1st Polypeptide | 2nd Polypeptide | 5th Polypeptide | 3rd Polypeptide | 6th Polypeptide |
| 6 | 4th Polypeptide | 1st Polypeptide | 2nd Polypeptide | 5th Polypeptide | 6th Polypeptide | 3rd Polypeptide |
| 6 | 4th Polypeptide | 1st Polypeptide | 2nd Polypeptide | 6th Polypeptide | 3rd Polypeptide | 5th Polypeptide |
| 6 | 4th Polypeptide | 1st Polypeptide | 2nd Polypeptide | 6th Polypeptide | 5th Polypeptide | 3rd Polypeptide |
| 6 | 4th Polypeptide | 1st Polypeptide | 3rd Polypeptide | 2nd Polypeptide | 5th Polypeptide | 6th Polypeptide |
| 6 | 4th Polypeptide | 1st Polypeptide | 3rd Polypeptide | 2nd Polypeptide | 6th Polypeptide | 5th Polypeptide |
| 6 | 4th Polypeptide | 1st Polypeptide | 3rd Polypeptide | 5th Polypeptide | 2nd Polypeptide | 6th Polypeptide |
| 6 | 4th Polypeptide | 1st Polypeptide | 3rd Polypeptide | 5th Polypeptide | 6th Polypeptide | 2nd Polypeptide |
| 6 | 4th Polypeptide | 1st Polypeptide | 3rd Polypeptide | 6th Polypeptide | 2nd Polypeptide | 5th Polypeptide |
| 6 | 4th Polypeptide | 1st Polypeptide | 3rd Polypeptide | 6th Polypeptide | 5th Polypeptide | 2nd Polypeptide |
| 6 | 4th Polypeptide | 1st Polypeptide | 5th Polypeptide | 2nd Polypeptide | 3rd Polypeptide | 6th Polypeptide |
| 6 | 4th Polypeptide | 1st Polypeptide | 5th Polypeptide | 2nd Polypeptide | 6th Polypeptide | 3rd Polypeptide |
| 6 | 4th Polypeptide | 1st Polypeptide | 5th Polypeptide | 3rd Polypeptide | 2nd Polypeptide | 6th Polypeptide |
| 6 | 4th Polypeptide | 1st Polypeptide | 5th Polypeptide | 3rd Polypeptide | 6th Polypeptide | 2nd Polypeptide |
| 6 | 4th Polypeptide | 1st Polypeptide | 5th Polypeptide | 6th Polypeptide | 2nd Polypeptide | 3rd Polypeptide |
| 6 | 4th Polypeptide | 1st Polypeptide | 5th Polypeptide | 6th Polypeptide | 3rd Polypeptide | 2nd Polypeptide |
| 6 | 4th Polypeptide | 1st Polypeptide | 6th Polypeptide | 2nd Polypeptide | 3rd Polypeptide | 5th Polypeptide |
| 6 | 4th Polypeptide | 1st Polypeptide | 6th Polypeptide | 2nd Polypeptide | 5th Polypeptide | 3rd Polypeptide |
| 6 | 4th Polypeptide | 1st Polypeptide | 6th Polypeptide | 3rd Polypeptide | 2nd Polypeptide | 5th Polypeptide |
| 6 | 4th Polypeptide | 1st Polypeptide | 6th Polypeptide | 3rd Polypeptide | 5th Polypeptide | 2nd Polypeptide |
| 6 | 4th Polypeptide | 1st Polypeptide | 6th Polypeptide | 5th Polypeptide | 2nd Polypeptide | 3rd Polypeptide |
| 6 | 4th Polypeptide | 1st Polypeptide | 6th Polypeptide | 5th Polypeptide | 3rd Polypeptide | 2nd Polypeptide |
| 6 | 4th Polypeptide | 2nd Polypeptide | 1st Polypeptide | 3rd Polypeptide | 5th Polypeptide | 6th Polypeptide |

-continued

| n | $X_1$ | $X_2$ | $X_3$ | $X_4$ | $X_5$ | $X_6$ |
|---|---|---|---|---|---|---|
| 6 | 4th Polypeptide | 2nd Polypeptide | 1st Polypeptide | 3rd Polypeptide | 6th Polypeptide | 5th Polypeptide |
| 6 | 4th Polypeptide | 2nd Polypeptide | 1st Polypeptide | 5th Polypeptide | 3rd Polypeptide | 6th Polypeptide |
| 6 | 4th Polypeptide | 2nd Polypeptide | 1st Polypeptide | 5th Polypeptide | 6th Polypeptide | 3rd Polypeptide |
| 6 | 4th Polypeptide | 2nd Polypeptide | 1st Polypeptide | 6th Polypeptide | 3rd Polypeptide | 5th Polypeptide |
| 6 | 4th Polypeptide | 2nd Polypeptide | 1st Polypeptide | 6th Polypeptide | 5th Polypeptide | 3rd Polypeptide |
| 6 | 4th Polypeptide | 2nd Polypeptide | 3rd Polypeptide | 1st Polypeptide | 5th Polypeptide | 6th Polypeptide |
| 6 | 4th Polypeptide | 2nd Polypeptide | 3rd Polypeptide | 1st Polypeptide | 6th Polypeptide | 5th Polypeptide |
| 6 | 4th Polypeptide | 2nd Polypeptide | 3rd Polypeptide | 5th Polypeptide | 1st Polypeptide | 6th Polypeptide |
| 6 | 4th Polypeptide | 2nd Polypeptide | 3rd Polypeptide | 5th Polypeptide | 6th Polypeptide | 1st Polypeptide |
| 6 | 4th Polypeptide | 2nd Polypeptide | 3rd Polypeptide | 6th Polypeptide | 1st Polypeptide | 5th Polypeptide |
| 6 | 4th Polypeptide | 2nd Polypeptide | 3rd Polypeptide | 6th Polypeptide | 5th Polypeptide | 1st Polypeptide |
| 6 | 4th Polypeptide | 2nd Polypeptide | 5th Polypeptide | 1st Polypeptide | 3rd Polypeptide | 6th Polypeptide |
| 6 | 4th Polypeptide | 2nd Polypeptide | 5th Polypeptide | 1st Polypeptide | 6th Polypeptide | 3rd Polypeptide |
| 6 | 4th Polypeptide | 2nd Polypeptide | 5th Polypeptide | 3rd Polypeptide | 1st Polypeptide | 6th Polypeptide |
| 6 | 4th Polypeptide | 2nd Polypeptide | 5th Polypeptide | 3rd Polypeptide | 6th Polypeptide | 1st Polypeptide |
| 6 | 4th Polypeptide | 2nd Polypeptide | 5th Polypeptide | 6th Polypeptide | 1st Polypeptide | 3rd Polypeptide |
| 6 | 4th Polypeptide | 2nd Polypeptide | 5th Polypeptide | 6th Polypeptide | 3rd Polypeptide | 1st Polypeptide |
| 6 | 4th Polypeptide | 2nd Polypeptide | 6th Polypeptide | 1st Polypeptide | 3rd Polypeptide | 5th Polypeptide |
| 6 | 4th Polypeptide | 2nd Polypeptide | 6th Polypeptide | 1st Polypeptide | 5th Polypeptide | 3rd Polypeptide |
| 6 | 4th Polypeptide | 2nd Polypeptide | 6th Polypeptide | 3rd Polypeptide | 1st Polypeptide | 5th Polypeptide |
| 6 | 4th Polypeptide | 2nd Polypeptide | 6th Polypeptide | 3rd Polypeptide | 5th Polypeptide | 1st Polypeptide |
| 6 | 4th Polypeptide | 2nd Polypeptide | 6th Polypeptide | 5th Polypeptide | 1st Polypeptide | 3rd Polypeptide |
| 6 | 4th Polypeptide | 2nd Polypeptide | 6th Polypeptide | 5th Polypeptide | 3rd Polypeptide | 1st Polypeptide |
| 6 | 4th Polypeptide | 3rd Polypeptide | 1st Polypeptide | 2nd Polypeptide | 5th Polypeptide | 6th Polypeptide |
| 6 | 4th Polypeptide | 3rd Polypeptide | 1st Polypeptide | 2nd Polypeptide | 6th Polypeptide | 5th Polypeptide |
| 6 | 4th Polypeptide | 3rd Polypeptide | 1st Polypeptide | 5th Polypeptide | 2nd Polypeptide | 6th Polypeptide |
| 6 | 4th Polypeptide | 3rd Polypeptide | 1st Polypeptide | 5th Polypeptide | 6th Polypeptide | 2nd Polypeptide |
| 6 | 4th Polypeptide | 3rd Polypeptide | 1st Polypeptide | 6th Polypeptide | 2nd Polypeptide | 5th Polypeptide |
| 6 | 4th Polypeptide | 3rd Polypeptide | 1st Polypeptide | 6th Polypeptide | 5th Polypeptide | 2nd Polypeptide |
| 6 | 4th Polypeptide | 3rd Polypeptide | 2nd Polypeptide | 1st Polypeptide | 5th Polypeptide | 6th Polypeptide |
| 6 | 4th Polypeptide | 3rd Polypeptide | 2nd Polypeptide | 1st Polypeptide | 6th Polypeptide | 5th Polypeptide |
| 6 | 4th Polypeptide | 3rd Polypeptide | 2nd Polypeptide | 5th Polypeptide | 1st Polypeptide | 6th Polypeptide |
| 6 | 4th Polypeptide | 3rd Polypeptide | 2nd Polypeptide | 5th Polypeptide | 6th Polypeptide | 1st Polypeptide |
| 6 | 4th Polypeptide | 3rd Polypeptide | 2nd Polypeptide | 6th Polypeptide | 1st Polypeptide | 5th Polypeptide |
| 6 | 4th Polypeptide | 3rd Polypeptide | 2nd Polypeptide | 6th Polypeptide | 5th Polypeptide | 1st Polypeptide |
| 6 | 4th Polypeptide | 3rd Polypeptide | 5th Polypeptide | 1st Polypeptide | 2nd Polypeptide | 6th Polypeptide |
| 6 | 4th Polypeptide | 3rd Polypeptide | 5th Polypeptide | 1st Polypeptide | 6th Polypeptide | 2nd Polypeptide |
| 6 | 4th Polypeptide | 3rd Polypeptide | 5th Polypeptide | 2nd Polypeptide | 1st Polypeptide | 6th Polypeptide |
| 6 | 4th Polypeptide | 3rd Polypeptide | 5th Polypeptide | 2nd Polypeptide | 6th Polypeptide | 1st Polypeptide |
| 6 | 4th Polypeptide | 3rd Polypeptide | 5th Polypeptide | 6th Polypeptide | 1st Polypeptide | 2nd Polypeptide |
| 6 | 4th Polypeptide | 3rd Polypeptide | 5th Polypeptide | 6th Polypeptide | 2nd Polypeptide | 1st Polypeptide |
| 6 | 4th Polypeptide | 3rd Polypeptide | 6th Polypeptide | 1st Polypeptide | 2nd Polypeptide | 5th Polypeptide |
| 6 | 4th Polypeptide | 3rd Polypeptide | 6th Polypeptide | 1st Polypeptide | 5th Polypeptide | 2nd Polypeptide |
| 6 | 4th Polypeptide | 3rd Polypeptide | 6th Polypeptide | 2nd Polypeptide | 1st Polypeptide | 5th Polypeptide |
| 6 | 4th Polypeptide | 3rd Polypeptide | 6th Polypeptide | 2nd Polypeptide | 5th Polypeptide | 1st Polypeptide |
| 6 | 4th Polypeptide | 3rd Polypeptide | 6th Polypeptide | 5th Polypeptide | 1st Polypeptide | 2nd Polypeptide |
| 6 | 4th Polypeptide | 3rd Polypeptide | 6th Polypeptide | 5th Polypeptide | 2nd Polypeptide | 1st Polypeptide |
| 6 | 4th Polypeptide | 5th Polypeptide | 1st Polypeptide | 2nd Polypeptide | 3rd Polypeptide | 6th Polypeptide |
| 6 | 4th Polypeptide | 5th Polypeptide | 1st Polypeptide | 2nd Polypeptide | 6th Polypeptide | 3rd Polypeptide |
| 6 | 4th Polypeptide | 5th Polypeptide | 1st Polypeptide | 3rd Polypeptide | 2nd Polypeptide | 6th Polypeptide |
| 6 | 4th Polypeptide | 5th Polypeptide | 1st Polypeptide | 3rd Polypeptide | 6th Polypeptide | 2nd Polypeptide |
| 6 | 4th Polypeptide | 5th Polypeptide | 1st Polypeptide | 6th Polypeptide | 2nd Polypeptide | 3rd Polypeptide |
| 6 | 4th Polypeptide | 5th Polypeptide | 1st Polypeptide | 6th Polypeptide | 3rd Polypeptide | 2nd Polypeptide |
| 6 | 4th Polypeptide | 5th Polypeptide | 2nd Polypeptide | 1st Polypeptide | 3rd Polypeptide | 6th Polypeptide |
| 6 | 4th Polypeptide | 5th Polypeptide | 2nd Polypeptide | 1st Polypeptide | 6th Polypeptide | 3rd Polypeptide |
| 6 | 4th Polypeptide | 5th Polypeptide | 2nd Polypeptide | 3rd Polypeptide | 1st Polypeptide | 6th Polypeptide |
| 6 | 4th Polypeptide | 5th Polypeptide | 2nd Polypeptide | 3rd Polypeptide | 6th Polypeptide | 1st Polypeptide |
| 6 | 4th Polypeptide | 5th Polypeptide | 2nd Polypeptide | 6th Polypeptide | 1st Polypeptide | 3rd Polypeptide |
| 6 | 4th Polypeptide | 5th Polypeptide | 2nd Polypeptide | 6th Polypeptide | 3rd Polypeptide | 1st Polypeptide |
| 6 | 4th Polypeptide | 5th Polypeptide | 3rd Polypeptide | 1st Polypeptide | 2nd Polypeptide | 6th Polypeptide |
| 6 | 4th Polypeptide | 5th Polypeptide | 3rd Polypeptide | 1st Polypeptide | 6th Polypeptide | 2nd Polypeptide |
| 6 | 4th Polypeptide | 5th Polypeptide | 3rd Polypeptide | 2nd Polypeptide | 1st Polypeptide | 6th Polypeptide |
| 6 | 4th Polypeptide | 5th Polypeptide | 3rd Polypeptide | 2nd Polypeptide | 6th Polypeptide | 1st Polypeptide |
| 6 | 4th Polypeptide | 5th Polypeptide | 3rd Polypeptide | 6th Polypeptide | 1st Polypeptide | 2nd Polypeptide |
| 6 | 4th Polypeptide | 5th Polypeptide | 3rd Polypeptide | 6th Polypeptide | 2nd Polypeptide | 1st Polypeptide |
| 6 | 4th Polypeptide | 5th Polypeptide | 6th Polypeptide | 1st Polypeptide | 2nd Polypeptide | 3rd Polypeptide |
| 6 | 4th Polypeptide | 5th Polypeptide | 6th Polypeptide | 1st Polypeptide | 3rd Polypeptide | 2nd Polypeptide |
| 6 | 4th Polypeptide | 5th Polypeptide | 6th Polypeptide | 2nd Polypeptide | 1st Polypeptide | 3rd Polypeptide |
| 6 | 4th Polypeptide | 5th Polypeptide | 6th Polypeptide | 2nd Polypeptide | 3rd Polypeptide | 1st Polypeptide |
| 6 | 4th Polypeptide | 5th Polypeptide | 6th Polypeptide | 3rd Polypeptide | 1st Polypeptide | 2nd Polypeptide |
| 6 | 4th Polypeptide | 5th Polypeptide | 6th Polypeptide | 3rd Polypeptide | 2nd Polypeptide | 1st Polypeptide |
| 6 | 4th Polypeptide | 6th Polypeptide | 1st Polypeptide | 2nd Polypeptide | 3rd Polypeptide | 5th Polypeptide |
| 6 | 4th Polypeptide | 6th Polypeptide | 1st Polypeptide | 2nd Polypeptide | 5th Polypeptide | 3rd Polypeptide |
| 6 | 4th Polypeptide | 6th Polypeptide | 1st Polypeptide | 3rd Polypeptide | 2nd Polypeptide | 5th Polypeptide |
| 6 | 4th Polypeptide | 6th Polypeptide | 1st Polypeptide | 3rd Polypeptide | 5th Polypeptide | 2nd Polypeptide |
| 6 | 4th Polypeptide | 6th Polypeptide | 1st Polypeptide | 5th Polypeptide | 2nd Polypeptide | 3rd Polypeptide |
| 6 | 4th Polypeptide | 6th Polypeptide | 1st Polypeptide | 5th Polypeptide | 3rd Polypeptide | 2nd Polypeptide |

-continued

| n | $X_1$ | $X_2$ | $X_3$ | $X_4$ | $X_5$ | $X_6$ |
|---|---|---|---|---|---|---|
| 6 | 4th Polypeptide | 6th Polypeptide | 2nd Polypeptide | 1st Polypeptide | 3rd Polypeptide | 5th Polypeptide |
| 6 | 4th Polypeptide | 6th Polypeptide | 2nd Polypeptide | 1st Polypeptide | 5th Polypeptide | 3rd Polypeptide |
| 6 | 4th Polypeptide | 6th Polypeptide | 2nd Polypeptide | 3rd Polypeptide | 1st Polypeptide | 5th Polypeptide |
| 6 | 4th Polypeptide | 6th Polypeptide | 2nd Polypeptide | 3rd Polypeptide | 5th Polypeptide | 1st Polypeptide |
| 6 | 4th Polypeptide | 6th Polypeptide | 2nd Polypeptide | 5th Polypeptide | 1st Polypeptide | 3rd Polypeptide |
| 6 | 4th Polypeptide | 6th Polypeptide | 2nd Polypeptide | 5th Polypeptide | 3rd Polypeptide | 1st Polypeptide |
| 6 | 4th Polypeptide | 6th Polypeptide | 3rd Polypeptide | 1st Polypeptide | 2nd Polypeptide | 5th Polypeptide |
| 6 | 4th Polypeptide | 6th Polypeptide | 3rd Polypeptide | 1st Polypeptide | 5th Polypeptide | 2nd Polypeptide |
| 6 | 4th Polypeptide | 6th Polypeptide | 3rd Polypeptide | 2nd Polypeptide | 1st Polypeptide | 5th Polypeptide |
| 6 | 4th Polypeptide | 6th Polypeptide | 3rd Polypeptide | 2nd Polypeptide | 5th Polypeptide | 1st Polypeptide |
| 6 | 4th Polypeptide | 6th Polypeptide | 3rd Polypeptide | 5th Polypeptide | 1st Polypeptide | 2nd Polypeptide |
| 6 | 4th Polypeptide | 6th Polypeptide | 3rd Polypeptide | 5th Polypeptide | 2nd Polypeptide | 1st Polypeptide |
| 6 | 4th Polypeptide | 6th Polypeptide | 5th Polypeptide | 1st Polypeptide | 2nd Polypeptide | 3rd Polypeptide |
| 6 | 4th Polypeptide | 6th Polypeptide | 5th Polypeptide | 1st Polypeptide | 3rd Polypeptide | 2nd Polypeptide |
| 6 | 4th Polypeptide | 6th Polypeptide | 5th Polypeptide | 2nd Polypeptide | 1st Polypeptide | 3rd Polypeptide |
| 6 | 4th Polypeptide | 6th Polypeptide | 5th Polypeptide | 2nd Polypeptide | 3rd Polypeptide | 1st Polypeptide |
| 6 | 4th Polypeptide | 6th Polypeptide | 5th Polypeptide | 3rd Polypeptide | 1st Polypeptide | 2nd Polypeptide |
| 6 | 4th Polypeptide | 6th Polypeptide | 5th Polypeptide | 3rd Polypeptide | 2nd Polypeptide | 1st Polypeptide |
| 6 | 5th Polypeptide | 1st Polypeptide | 2nd Polypeptide | 3rd Polypeptide | 4th Polypeptide | 6th Polypeptide |
| 6 | 5th Polypeptide | 1st Polypeptide | 2nd Polypeptide | 3rd Polypeptide | 6th Polypeptide | 4th Polypeptide |
| 6 | 5th Polypeptide | 1st Polypeptide | 2nd Polypeptide | 4th Polypeptide | 3rd Polypeptide | 6th Polypeptide |
| 6 | 5th Polypeptide | 1st Polypeptide | 2nd Polypeptide | 4th Polypeptide | 6th Polypeptide | 3rd Polypeptide |
| 6 | 5th Polypeptide | 1st Polypeptide | 2nd Polypeptide | 6th Polypeptide | 3rd Polypeptide | 4th Polypeptide |
| 6 | 5th Polypeptide | 1st Polypeptide | 2nd Polypeptide | 6th Polypeptide | 4th Polypeptide | 3rd Polypeptide |
| 6 | 5th Polypeptide | 1st Polypeptide | 3rd Polypeptide | 2nd Polypeptide | 4th Polypeptide | 6th Polypeptide |
| 6 | 5th Polypeptide | 1st Polypeptide | 3rd Polypeptide | 2nd Polypeptide | 6th Polypeptide | 4th Polypeptide |
| 6 | 5th Polypeptide | 1st Polypeptide | 3rd Polypeptide | 4th Polypeptide | 2nd Polypeptide | 6th Polypeptide |
| 6 | 5th Polypeptide | 1st Polypeptide | 3rd Polypeptide | 4th Polypeptide | 6th Polypeptide | 2nd Polypeptide |
| 6 | 5th Polypeptide | 1st Polypeptide | 3rd Polypeptide | 6th Polypeptide | 2nd Polypeptide | 4th Polypeptide |
| 6 | 5th Polypeptide | 1st Polypeptide | 3rd Polypeptide | 6th Polypeptide | 4th Polypeptide | 2nd Polypeptide |
| 6 | 5th Polypeptide | 1st Polypeptide | 4th Polypeptide | 2nd Polypeptide | 3rd Polypeptide | 6th Polypeptide |
| 6 | 5th Polypeptide | 1st Polypeptide | 4th Polypeptide | 2nd Polypeptide | 6th Polypeptide | 3rd Polypeptide |
| 6 | 5th Polypeptide | 1st Polypeptide | 4th Polypeptide | 3rd Polypeptide | 2nd Polypeptide | 6th Polypeptide |
| 6 | 5th Polypeptide | 1st Polypeptide | 4th Polypeptide | 3rd Polypeptide | 6th Polypeptide | 2nd Polypeptide |
| 6 | 5th Polypeptide | 1st Polypeptide | 4th Polypeptide | 6th Polypeptide | 2nd Polypeptide | 3rd Polypeptide |
| 6 | 5th Polypeptide | 1st Polypeptide | 4th Polypeptide | 6th Polypeptide | 3rd Polypeptide | 2nd Polypeptide |
| 6 | 5th Polypeptide | 1st Polypeptide | 6th Polypeptide | 2nd Polypeptide | 3rd Polypeptide | 4th Polypeptide |
| 6 | 5th Polypeptide | 1st Polypeptide | 6th Polypeptide | 2nd Polypeptide | 4th Polypeptide | 3rd Polypeptide |
| 6 | 5th Polypeptide | 1st Polypeptide | 6th Polypeptide | 3rd Polypeptide | 2nd Polypeptide | 4th Polypeptide |
| 6 | 5th Polypeptide | 1st Polypeptide | 6th Polypeptide | 3rd Polypeptide | 4th Polypeptide | 2nd Polypeptide |
| 6 | 5th Polypeptide | 1st Polypeptide | 6th Polypeptide | 4th Polypeptide | 2nd Polypeptide | 3rd Polypeptide |
| 6 | 5th Polypeptide | 1st Polypeptide | 6th Polypeptide | 4th Polypeptide | 3rd Polypeptide | 2nd Polypeptide |
| 6 | 5th Polypeptide | 2nd Polypeptide | 1st Polypeptide | 3rd Polypeptide | 4th Polypeptide | 6th Polypeptide |
| 6 | 5th Polypeptide | 2nd Polypeptide | 1st Polypeptide | 3rd Polypeptide | 6th Polypeptide | 4th Polypeptide |
| 6 | 5th Polypeptide | 2nd Polypeptide | 1st Polypeptide | 4th Polypeptide | 3rd Polypeptide | 6th Polypeptide |
| 6 | 5th Polypeptide | 2nd Polypeptide | 1st Polypeptide | 4th Polypeptide | 6th Polypeptide | 3rd Polypeptide |
| 6 | 5th Polypeptide | 2nd Polypeptide | 1st Polypeptide | 6th Polypeptide | 3rd Polypeptide | 4th Polypeptide |
| 6 | 5th Polypeptide | 2nd Polypeptide | 1st Polypeptide | 6th Polypeptide | 4th Polypeptide | 3rd Polypeptide |
| 6 | 5th Polypeptide | 2nd Polypeptide | 3rd Polypeptide | 1st Polypeptide | 4th Polypeptide | 6th Polypeptide |
| 6 | 5th Polypeptide | 2nd Polypeptide | 3rd Polypeptide | 1st Polypeptide | 6th Polypeptide | 4th Polypeptide |
| 6 | 5th Polypeptide | 2nd Polypeptide | 3rd Polypeptide | 4th Polypeptide | 1st Polypeptide | 6th Polypeptide |
| 6 | 5th Polypeptide | 2nd Polypeptide | 3rd Polypeptide | 4th Polypeptide | 6th Polypeptide | 1st Polypeptide |
| 6 | 5th Polypeptide | 2nd Polypeptide | 3rd Polypeptide | 6th Polypeptide | 1st Polypeptide | 4th Polypeptide |
| 6 | 5th Polypeptide | 2nd Polypeptide | 3rd Polypeptide | 6th Polypeptide | 4th Polypeptide | 1st Polypeptide |
| 6 | 5th Polypeptide | 2nd Polypeptide | 4th Polypeptide | 1st Polypeptide | 3rd Polypeptide | 6th Polypeptide |
| 6 | 5th Polypeptide | 2nd Polypeptide | 4th Polypeptide | 1st Polypeptide | 6th Polypeptide | 3rd Polypeptide |
| 6 | 5th Polypeptide | 2nd Polypeptide | 4th Polypeptide | 3rd Polypeptide | 1st Polypeptide | 6th Polypeptide |
| 6 | 5th Polypeptide | 2nd Polypeptide | 4th Polypeptide | 3rd Polypeptide | 6th Polypeptide | 1st Polypeptide |
| 6 | 5th Polypeptide | 2nd Polypeptide | 4th Polypeptide | 6th Polypeptide | 1st Polypeptide | 3rd Polypeptide |
| 6 | 5th Polypeptide | 2nd Polypeptide | 4th Polypeptide | 6th Polypeptide | 3rd Polypeptide | 1st Polypeptide |
| 6 | 5th Polypeptide | 2nd Polypeptide | 6th Polypeptide | 1st Polypeptide | 3rd Polypeptide | 4th Polypeptide |
| 6 | 5th Polypeptide | 2nd Polypeptide | 6th Polypeptide | 1st Polypeptide | 4th Polypeptide | 3rd Polypeptide |
| 6 | 5th Polypeptide | 2nd Polypeptide | 6th Polypeptide | 3rd Polypeptide | 1st Polypeptide | 4th Polypeptide |
| 6 | 5th Polypeptide | 2nd Polypeptide | 6th Polypeptide | 3rd Polypeptide | 4th Polypeptide | 1st Polypeptide |
| 6 | 5th Polypeptide | 2nd Polypeptide | 6th Polypeptide | 4th Polypeptide | 1st Polypeptide | 3rd Polypeptide |
| 6 | 5th Polypeptide | 2nd Polypeptide | 6th Polypeptide | 4th Polypeptide | 3rd Polypeptide | 1st Polypeptide |
| 6 | 5th Polypeptide | 3rd Polypeptide | 1st Polypeptide | 2nd Polypeptide | 4th Polypeptide | 6th Polypeptide |
| 6 | 5th Polypeptide | 3rd Polypeptide | 1st Polypeptide | 2nd Polypeptide | 6th Polypeptide | 4th Polypeptide |
| 6 | 5th Polypeptide | 3rd Polypeptide | 1st Polypeptide | 4th Polypeptide | 2nd Polypeptide | 6th Polypeptide |
| 6 | 5th Polypeptide | 3rd Polypeptide | 1st Polypeptide | 4th Polypeptide | 6th Polypeptide | 2nd Polypeptide |
| 6 | 5th Polypeptide | 3rd Polypeptide | 1st Polypeptide | 6th Polypeptide | 2nd Polypeptide | 4th Polypeptide |
| 6 | 5th Polypeptide | 3rd Polypeptide | 1st Polypeptide | 6th Polypeptide | 4th Polypeptide | 2nd Polypeptide |
| 6 | 5th Polypeptide | 3rd Polypeptide | 2nd Polypeptide | 1st Polypeptide | 4th Polypeptide | 6th Polypeptide |
| 6 | 5th Polypeptide | 3rd Polypeptide | 2nd Polypeptide | 1st Polypeptide | 6th Polypeptide | 4th Polypeptide |
| 6 | 5th Polypeptide | 3rd Polypeptide | 2nd Polypeptide | 4th Polypeptide | 1st Polypeptide | 6th Polypeptide |
| 6 | 5th Polypeptide | 3rd Polypeptide | 2nd Polypeptide | 4th Polypeptide | 6th Polypeptide | 1st Polypeptide |
| 6 | 5th Polypeptide | 3rd Polypeptide | 2nd Polypeptide | 6th Polypeptide | 1st Polypeptide | 4th Polypeptide |

-continued

| n | $X_1$ | $X_2$ | $X_3$ | $X_4$ | $X_5$ | $X_6$ |
|---|---|---|---|---|---|---|
| 6 | 5th Polypeptide | 3rd Polypeptide | 2nd Polypeptide | 6th Polypeptide | 4th Polypeptide | 1st Polypeptide |
| 6 | 5th Polypeptide | 3rd Polypeptide | 4th Polypeptide | 1st Polypeptide | 2nd Polypeptide | 6th Polypeptide |
| 6 | 5th Polypeptide | 3rd Polypeptide | 4th Polypeptide | 1st Polypeptide | 6th Polypeptide | 2nd Polypeptide |
| 6 | 5th Polypeptide | 3rd Polypeptide | 4th Polypeptide | 2nd Polypeptide | 1st Polypeptide | 6th Polypeptide |
| 6 | 5th Polypeptide | 3rd Polypeptide | 4th Polypeptide | 2nd Polypeptide | 6th Polypeptide | 1st Polypeptide |
| 6 | 5th Polypeptide | 3rd Polypeptide | 4th Polypeptide | 6th Polypeptide | 1st Polypeptide | 2nd Polypeptide |
| 6 | 5th Polypeptide | 3rd Polypeptide | 4th Polypeptide | 6th Polypeptide | 2nd Polypeptide | 1st Polypeptide |
| 6 | 5th Polypeptide | 3rd Polypeptide | 6th Polypeptide | 1st Polypeptide | 2nd Polypeptide | 4th Polypeptide |
| 6 | 5th Polypeptide | 3rd Polypeptide | 6th Polypeptide | 1st Polypeptide | 4th Polypeptide | 2nd Polypeptide |
| 6 | 5th Polypeptide | 3rd Polypeptide | 6th Polypeptide | 2nd Polypeptide | 1st Polypeptide | 4th Polypeptide |
| 6 | 5th Polypeptide | 3rd Polypeptide | 6th Polypeptide | 2nd Polypeptide | 4th Polypeptide | 1st Polypeptide |
| 6 | 5th Polypeptide | 3rd Polypeptide | 6th Polypeptide | 4th Polypeptide | 1st Polypeptide | 2nd Polypeptide |
| 6 | 5th Polypeptide | 3rd Polypeptide | 6th Polypeptide | 4th Polypeptide | 2nd Polypeptide | 1st Polypeptide |
| 6 | 5th Polypeptide | 4th Polypeptide | 1st Polypeptide | 2nd Polypeptide | 3rd Polypeptide | 6th Polypeptide |
| 6 | 5th Polypeptide | 4th Polypeptide | 1st Polypeptide | 2nd Polypeptide | 6th Polypeptide | 3rd Polypeptide |
| 6 | 5th Polypeptide | 4th Polypeptide | 1st Polypeptide | 3rd Polypeptide | 2nd Polypeptide | 6th Polypeptide |
| 6 | 5th Polypeptide | 4th Polypeptide | 1st Polypeptide | 3rd Polypeptide | 6th Polypeptide | 2nd Polypeptide |
| 6 | 5th Polypeptide | 4th Polypeptide | 1st Polypeptide | 6th Polypeptide | 2nd Polypeptide | 3rd Polypeptide |
| 6 | 5th Polypeptide | 4th Polypeptide | 1st Polypeptide | 6th Polypeptide | 3rd Polypeptide | 2nd Polypeptide |
| 6 | 5th Polypeptide | 4th Polypeptide | 2nd Polypeptide | 1st Polypeptide | 3rd Polypeptide | 6th Polypeptide |
| 6 | 5th Polypeptide | 4th Polypeptide | 2nd Polypeptide | 1st Polypeptide | 6th Polypeptide | 3rd Polypeptide |
| 6 | 5th Polypeptide | 4th Polypeptide | 2nd Polypeptide | 3rd Polypeptide | 1st Polypeptide | 6th Polypeptide |
| 6 | 5th Polypeptide | 4th Polypeptide | 2nd Polypeptide | 3rd Polypeptide | 6th Polypeptide | 1st Polypeptide |
| 6 | 5th Polypeptide | 4th Polypeptide | 2nd Polypeptide | 6th Polypeptide | 1st Polypeptide | 3rd Polypeptide |
| 6 | 5th Polypeptide | 4th Polypeptide | 2nd Polypeptide | 6th Polypeptide | 3rd Polypeptide | 1st Polypeptide |
| 6 | 5th Polypeptide | 4th Polypeptide | 3rd Polypeptide | 1st Polypeptide | 2nd Polypeptide | 6th Polypeptide |
| 6 | 5th Polypeptide | 4th Polypeptide | 3rd Polypeptide | 1st Polypeptide | 6th Polypeptide | 2nd Polypeptide |
| 6 | 5th Polypeptide | 4th Polypeptide | 3rd Polypeptide | 2nd Polypeptide | 1st Polypeptide | 6th Polypeptide |
| 6 | 5th Polypeptide | 4th Polypeptide | 3rd Polypeptide | 2nd Polypeptide | 6th Polypeptide | 1st Polypeptide |
| 6 | 5th Polypeptide | 4th Polypeptide | 3rd Polypeptide | 6th Polypeptide | 1st Polypeptide | 2nd Polypeptide |
| 6 | 5th Polypeptide | 4th Polypeptide | 3rd Polypeptide | 6th Polypeptide | 2nd Polypeptide | 1st Polypeptide |
| 6 | 5th Polypeptide | 4th Polypeptide | 6th Polypeptide | 1st Polypeptide | 2nd Polypeptide | 3rd Polypeptide |
| 6 | 5th Polypeptide | 4th Polypeptide | 6th Polypeptide | 1st Polypeptide | 3rd Polypeptide | 2nd Polypeptide |
| 6 | 5th Polypeptide | 4th Polypeptide | 6th Polypeptide | 2nd Polypeptide | 1st Polypeptide | 3rd Polypeptide |
| 6 | 5th Polypeptide | 4th Polypeptide | 6th Polypeptide | 2nd Polypeptide | 3rd Polypeptide | 1st Polypeptide |
| 6 | 5th Polypeptide | 4th Polypeptide | 6th Polypeptide | 3rd Polypeptide | 1st Polypeptide | 2nd Polypeptide |
| 6 | 5th Polypeptide | 4th Polypeptide | 6th Polypeptide | 3rd Polypeptide | 2nd Polypeptide | 1st Polypeptide |
| 6 | 5th Polypeptide | 6th Polypeptide | 1st Polypeptide | 2nd Polypeptide | 3rd Polypeptide | 4th Polypeptide |
| 6 | 5th Polypeptide | 6th Polypeptide | 1st Polypeptide | 2nd Polypeptide | 4th Polypeptide | 3rd Polypeptide |
| 6 | 5th Polypeptide | 6th Polypeptide | 1st Polypeptide | 3rd Polypeptide | 2nd Polypeptide | 4th Polypeptide |
| 6 | 5th Polypeptide | 6th Polypeptide | 1st Polypeptide | 3rd Polypeptide | 4th Polypeptide | 2nd Polypeptide |
| 6 | 5th Polypeptide | 6th Polypeptide | 1st Polypeptide | 4th Polypeptide | 2nd Polypeptide | 3rd Polypeptide |
| 6 | 5th Polypeptide | 6th Polypeptide | 1st Polypeptide | 4th Polypeptide | 3rd Polypeptide | 2nd Polypeptide |
| 6 | 5th Polypeptide | 6th Polypeptide | 2nd Polypeptide | 1st Polypeptide | 3rd Polypeptide | 4th Polypeptide |
| 6 | 5th Polypeptide | 6th Polypeptide | 2nd Polypeptide | 1st Polypeptide | 4th Polypeptide | 3rd Polypeptide |
| 6 | 5th Polypeptide | 6th Polypeptide | 2nd Polypeptide | 3rd Polypeptide | 1st Polypeptide | 4th Polypeptide |
| 6 | 5th Polypeptide | 6th Polypeptide | 2nd Polypeptide | 3rd Polypeptide | 4th Polypeptide | 1st Polypeptide |
| 6 | 5th Polypeptide | 6th Polypeptide | 2nd Polypeptide | 4th Polypeptide | 1st Polypeptide | 3rd Polypeptide |
| 6 | 5th Polypeptide | 6th Polypeptide | 2nd Polypeptide | 4th Polypeptide | 3rd Polypeptide | 1st Polypeptide |
| 6 | 5th Polypeptide | 6th Polypeptide | 3rd Polypeptide | 1st Polypeptide | 2nd Polypeptide | 4th Polypeptide |
| 6 | 5th Polypeptide | 6th Polypeptide | 3rd Polypeptide | 1st Polypeptide | 4th Polypeptide | 2nd Polypeptide |
| 6 | 5th Polypeptide | 6th Polypeptide | 3rd Polypeptide | 2nd Polypeptide | 1st Polypeptide | 4th Polypeptide |
| 6 | 5th Polypeptide | 6th Polypeptide | 3rd Polypeptide | 2nd Polypeptide | 4th Polypeptide | 1st Polypeptide |
| 6 | 5th Polypeptide | 6th Polypeptide | 3rd Polypeptide | 4th Polypeptide | 1st Polypeptide | 2nd Polypeptide |
| 6 | 5th Polypeptide | 6th Polypeptide | 3rd Polypeptide | 4th Polypeptide | 2nd Polypeptide | 1st Polypeptide |
| 6 | 5th Polypeptide | 6th Polypeptide | 4th Polypeptide | 1st Polypeptide | 2nd Polypeptide | 3rd Polypeptide |
| 6 | 5th Polypeptide | 6th Polypeptide | 4th Polypeptide | 1st Polypeptide | 3rd Polypeptide | 2nd Polypeptide |
| 6 | 5th Polypeptide | 6th Polypeptide | 4th Polypeptide | 2nd Polypeptide | 1st Polypeptide | 3rd Polypeptide |
| 6 | 5th Polypeptide | 6th Polypeptide | 4th Polypeptide | 2nd Polypeptide | 3rd Polypeptide | 1st Polypeptide |
| 6 | 5th Polypeptide | 6th Polypeptide | 4th Polypeptide | 3rd Polypeptide | 1st Polypeptide | 2nd Polypeptide |
| 6 | 5th Polypeptide | 6th Polypeptide | 4th Polypeptide | 3rd Polypeptide | 2nd Polypeptide | 1st Polypeptide |
| 6 | 6th Polypeptide | 1st Polypeptide | 2nd Polypeptide | 3rd Polypeptide | 4th Polypeptide | 5th Polypeptide |
| 6 | 6th Polypeptide | 1st Polypeptide | 2nd Polypeptide | 3rd Polypeptide | 5th Polypeptide | 4th Polypeptide |
| 6 | 6th Polypeptide | 1st Polypeptide | 2nd Polypeptide | 4th Polypeptide | 3rd Polypeptide | 5th Polypeptide |
| 6 | 6th Polypeptide | 1st Polypeptide | 2nd Polypeptide | 4th Polypeptide | 5th Polypeptide | 3rd Polypeptide |
| 6 | 6th Polypeptide | 1st Polypeptide | 2nd Polypeptide | 5th Polypeptide | 3rd Polypeptide | 4th Polypeptide |
| 6 | 6th Polypeptide | 1st Polypeptide | 2nd Polypeptide | 5th Polypeptide | 4th Polypeptide | 3rd Polypeptide |
| 6 | 6th Polypeptide | 1st Polypeptide | 3rd Polypeptide | 2nd Polypeptide | 4th Polypeptide | 5th Polypeptide |
| 6 | 6th Polypeptide | 1st Polypeptide | 3rd Polypeptide | 2nd Polypeptide | 5th Polypeptide | 4th Polypeptide |
| 6 | 6th Polypeptide | 1st Polypeptide | 3rd Polypeptide | 4th Polypeptide | 2nd Polypeptide | 5th Polypeptide |
| 6 | 6th Polypeptide | 1st Polypeptide | 3rd Polypeptide | 4th Polypeptide | 5th Polypeptide | 2nd Polypeptide |
| 6 | 6th Polypeptide | 1st Polypeptide | 3rd Polypeptide | 5th Polypeptide | 4th Polypeptide | 2nd Polypeptide |
| 6 | 6th Polypeptide | 1st Polypeptide | 4th Polypeptide | 2nd Polypeptide | 3rd Polypeptide | 5th Polypeptide |
| 6 | 6th Polypeptide | 1st Polypeptide | 4th Polypeptide | 2nd Polypeptide | 5th Polypeptide | 3rd Polypeptide |
| 6 | 6th Polypeptide | 1st Polypeptide | 4th Polypeptide | 3rd Polypeptide | 2nd Polypeptide | 5th Polypeptide |
| 6 | 6th Polypeptide | 1st Polypeptide | 4th Polypeptide | 3rd Polypeptide | 5th Polypeptide | 2nd Polypeptide |

-continued

| n | $X_1$ | $X_2$ | $X_3$ | $X_4$ | $X_5$ | $X_6$ |
|---|---|---|---|---|---|---|
| 6 | 6th Polypeptide | 1st Polypeptide | 4th Polypeptide | 5th Polypeptide | 2nd Polypeptide | 3rd Polypeptide |
| 6 | 6th Polypeptide | 1st Polypeptide | 4th Polypeptide | 5th Polypeptide | 3rd Polypeptide | 2nd Polypeptide |
| 6 | 6th Polypeptide | 1st Polypeptide | 5th Polypeptide | 2nd Polypeptide | 3rd Polypeptide | 4th Polypeptide |
| 6 | 6th Polypeptide | 1st Polypeptide | 5th Polypeptide | 2nd Polypeptide | 4th Polypeptide | 3rd Polypeptide |
| 6 | 6th Polypeptide | 1st Polypeptide | 5th Polypeptide | 3rd Polypeptide | 2nd Polypeptide | 4th Polypeptide |
| 6 | 6th Polypeptide | 1st Polypeptide | 5th Polypeptide | 3rd Polypeptide | 4th Polypeptide | 2nd Polypeptide |
| 6 | 6th Polypeptide | 1st Polypeptide | 5th Polypeptide | 4th Polypeptide | 2nd Polypeptide | 3rd Polypeptide |
| 6 | 6th Polypeptide | 1st Polypeptide | 5th Polypeptide | 4th Polypeptide | 3rd Polypeptide | 2nd Polypeptide |
| 6 | 6th Polypeptide | 2nd Polypeptide | 1st Polypeptide | 3rd Polypeptide | 4th Polypeptide | 5th Polypeptide |
| 6 | 6th Polypeptide | 2nd Polypeptide | 1st Polypeptide | 3rd Polypeptide | 5th Polypeptide | 4th Polypeptide |
| 6 | 6th Polypeptide | 2nd Polypeptide | 1st Polypeptide | 4th Polypeptide | 3rd Polypeptide | 5th Polypeptide |
| 6 | 6th Polypeptide | 2nd Polypeptide | 1st Polypeptide | 4th Polypeptide | 5th Polypeptide | 3rd Polypeptide |
| 6 | 6th Polypeptide | 2nd Polypeptide | 1st Polypeptide | 5th Polypeptide | 3rd Polypeptide | 4th Polypeptide |
| 6 | 6th Polypeptide | 2nd Polypeptide | 1st Polypeptide | 5th Polypeptide | 4th Polypeptide | 3rd Polypeptide |
| 6 | 6th Polypeptide | 2nd Polypeptide | 3rd Polypeptide | 1st Polypeptide | 4th Polypeptide | 5th Polypeptide |
| 6 | 6th Polypeptide | 2nd Polypeptide | 3rd Polypeptide | 1st Polypeptide | 5th Polypeptide | 4th Polypeptide |
| 6 | 6th Polypeptide | 2nd Polypeptide | 3rd Polypeptide | 4th Polypeptide | 1st Polypeptide | 5th Polypeptide |
| 6 | 6th Polypeptide | 2nd Polypeptide | 3rd Polypeptide | 4th Polypeptide | 5th Polypeptide | 1st Polypeptide |
| 6 | 6th Polypeptide | 2nd Polypeptide | 3rd Polypeptide | 5th Polypeptide | 1st Polypeptide | 4th Polypeptide |
| 6 | 6th Polypeptide | 2nd Polypeptide | 3rd Polypeptide | 5th Polypeptide | 4th Polypeptide | 1st Polypeptide |
| 6 | 6th Polypeptide | 2nd Polypeptide | 4th Polypeptide | 1st Polypeptide | 3rd Polypeptide | 5th Polypeptide |
| 6 | 6th Polypeptide | 2nd Polypeptide | 4th Polypeptide | 1st Polypeptide | 5th Polypeptide | 3rd Polypeptide |
| 6 | 6th Polypeptide | 2nd Polypeptide | 4th Polypeptide | 3rd Polypeptide | 1st Polypeptide | 5th Polypeptide |
| 6 | 6th Polypeptide | 2nd Polypeptide | 4th Polypeptide | 3rd Polypeptide | 5th Polypeptide | 1st Polypeptide |
| 6 | 6th Polypeptide | 2nd Polypeptide | 4th Polypeptide | 5th Polypeptide | 1st Polypeptide | 3rd Polypeptide |
| 6 | 6th Polypeptide | 2nd Polypeptide | 4th Polypeptide | 5th Polypeptide | 3rd Polypeptide | 1st Polypeptide |
| 6 | 6th Polypeptide | 2nd Polypeptide | 5th Polypeptide | 1st Polypeptide | 3rd Polypeptide | 4th Polypeptide |
| 6 | 6th Polypeptide | 2nd Polypeptide | 5th Polypeptide | 1st Polypeptide | 4th Polypeptide | 3rd Polypeptide |
| 6 | 6th Polypeptide | 2nd Polypeptide | 5th Polypeptide | 3rd Polypeptide | 1st Polypeptide | 4th Polypeptide |
| 6 | 6th Polypeptide | 2nd Polypeptide | 5th Polypeptide | 3rd Polypeptide | 4th Polypeptide | 1st Polypeptide |
| 6 | 6th Polypeptide | 2nd Polypeptide | 5th Polypeptide | 4th Polypeptide | 1st Polypeptide | 3rd Polypeptide |
| 6 | 6th Polypeptide | 2nd Polypeptide | 5th Polypeptide | 4th Polypeptide | 3rd Polypeptide | 1st Polypeptide |
| 6 | 6th Polypeptide | 3rd Polypeptide | 1st Polypeptide | 2nd Polypeptide | 4th Polypeptide | 5th Polypeptide |
| 6 | 6th Polypeptide | 3rd Polypeptide | 1st Polypeptide | 2nd Polypeptide | 5th Polypeptide | 4th Polypeptide |
| 6 | 6th Polypeptide | 3rd Polypeptide | 1st Polypeptide | 4th Polypeptide | 2nd Polypeptide | 5th Polypeptide |
| 6 | 6th Polypeptide | 3rd Polypeptide | 1st Polypeptide | 4th Polypeptide | 5th Polypeptide | 2nd Polypeptide |
| 6 | 6th Polypeptide | 3rd Polypeptide | 1st Polypeptide | 5th Polypeptide | 2nd Polypeptide | 4th Polypeptide |
| 6 | 6th Polypeptide | 3rd Polypeptide | 1st Polypeptide | 5th Polypeptide | 4th Polypeptide | 2nd Polypeptide |
| 6 | 6th Polypeptide | 3rd Polypeptide | 2nd Polypeptide | 1st Polypeptide | 4th Polypeptide | 5th Polypeptide |
| 6 | 6th Polypeptide | 3rd Polypeptide | 2nd Polypeptide | 1st Polypeptide | 5th Polypeptide | 4th Polypeptide |
| 6 | 6th Polypeptide | 3rd Polypeptide | 2nd Polypeptide | 4th Polypeptide | 1st Polypeptide | 5th Polypeptide |
| 6 | 6th Polypeptide | 3rd Polypeptide | 2nd Polypeptide | 4th Polypeptide | 5th Polypeptide | 1st Polypeptide |
| 6 | 6th Polypeptide | 3rd Polypeptide | 2nd Polypeptide | 5th Polypeptide | 1st Polypeptide | 4th Polypeptide |
| 6 | 6th Polypeptide | 3rd Polypeptide | 2nd Polypeptide | 5th Polypeptide | 4th Polypeptide | 1st Polypeptide |
| 6 | 6th Polypeptide | 3rd Polypeptide | 4th Polypeptide | 1st Polypeptide | 2nd Polypeptide | 5th Polypeptide |
| 6 | 6th Polypeptide | 3rd Polypeptide | 4th Polypeptide | 1st Polypeptide | 5th Polypeptide | 2nd Polypeptide |
| 6 | 6th Polypeptide | 3rd Polypeptide | 4th Polypeptide | 2nd Polypeptide | 1st Polypeptide | 5th Polypeptide |
| 6 | 6th Polypeptide | 3rd Polypeptide | 4th Polypeptide | 2nd Polypeptide | 5th Polypeptide | 1st Polypeptide |
| 6 | 6th Polypeptide | 3rd Polypeptide | 4th Polypeptide | 5th Polypeptide | 1st Polypeptide | 2nd Polypeptide |
| 6 | 6th Polypeptide | 3rd Polypeptide | 4th Polypeptide | 5th Polypeptide | 2nd Polypeptide | 1st Polypeptide |
| 6 | 6th Polypeptide | 3rd Polypeptide | 5th Polypeptide | 1st Polypeptide | 2nd Polypeptide | 4th Polypeptide |
| 6 | 6th Polypeptide | 3rd Polypeptide | 5th Polypeptide | 1st Polypeptide | 4th Polypeptide | 2nd Polypeptide |
| 6 | 6th Polypeptide | 3rd Polypeptide | 5th Polypeptide | 2nd Polypeptide | 1st Polypeptide | 4th Polypeptide |
| 6 | 6th Polypeptide | 3rd Polypeptide | 5th Polypeptide | 2nd Polypeptide | 4th Polypeptide | 1st Polypeptide |
| 6 | 6th Polypeptide | 3rd Polypeptide | 5th Polypeptide | 4th Polypeptide | 1st Polypeptide | 2nd Polypeptide |
| 6 | 6th Polypeptide | 3rd Polypeptide | 5th Polypeptide | 4th Polypeptide | 2nd Polypeptide | 1st Polypeptide |
| 6 | 6th Polypeptide | 4th Polypeptide | 1st Polypeptide | 2nd Polypeptide | 3rd Polypeptide | 5th Polypeptide |
| 6 | 6th Polypeptide | 4th Polypeptide | 1st Polypeptide | 2nd Polypeptide | 5th Polypeptide | 3rd Polypeptide |
| 6 | 6th Polypeptide | 4th Polypeptide | 1st Polypeptide | 3rd Polypeptide | 2nd Polypeptide | 5th Polypeptide |
| 6 | 6th Polypeptide | 4th Polypeptide | 1st Polypeptide | 3rd Polypeptide | 5th Polypeptide | 2nd Polypeptide |
| 6 | 6th Polypeptide | 4th Polypeptide | 1st Polypeptide | 5th Polypeptide | 2nd Polypeptide | 3rd Polypeptide |
| 6 | 6th Polypeptide | 4th Polypeptide | 1st Polypeptide | 5th Polypeptide | 3rd Polypeptide | 2nd Polypeptide |
| 6 | 6th Polypeptide | 4th Polypeptide | 2nd Polypeptide | 1st Polypeptide | 3rd Polypeptide | 5th Polypeptide |
| 6 | 6th Polypeptide | 4th Polypeptide | 2nd Polypeptide | 1st Polypeptide | 5th Polypeptide | 3rd Polypeptide |
| 6 | 6th Polypeptide | 4th Polypeptide | 2nd Polypeptide | 3rd Polypeptide | 1st Polypeptide | 5th Polypeptide |
| 6 | 6th Polypeptide | 4th Polypeptide | 2nd Polypeptide | 3rd Polypeptide | 5th Polypeptide | 1st Polypeptide |
| 6 | 6th Polypeptide | 4th Polypeptide | 2nd Polypeptide | 5th Polypeptide | 1st Polypeptide | 3rd Polypeptide |
| 6 | 6th Polypeptide | 4th Polypeptide | 2nd Polypeptide | 5th Polypeptide | 3rd Polypeptide | 1st Polypeptide |
| 6 | 6th Polypeptide | 4th Polypeptide | 3rd Polypeptide | 1st Polypeptide | 2nd Polypeptide | 5th Polypeptide |
| 6 | 6th Polypeptide | 4th Polypeptide | 3rd Polypeptide | 1st Polypeptide | 5th Polypeptide | 2nd Polypeptide |
| 6 | 6th Polypeptide | 4th Polypeptide | 3rd Polypeptide | 2nd Polypeptide | 1st Polypeptide | 5th Polypeptide |
| 6 | 6th Polypeptide | 4th Polypeptide | 3rd Polypeptide | 2nd Polypeptide | 5th Polypeptide | 1st Polypeptide |
| 6 | 6th Polypeptide | 4th Polypeptide | 3rd Polypeptide | 5th Polypeptide | 1st Polypeptide | 2nd Polypeptide |
| 6 | 6th Polypeptide | 4th Polypeptide | 3rd Polypeptide | 5th Polypeptide | 2nd Polypeptide | 1st Polypeptide |
| 6 | 6th Polypeptide | 4th Polypeptide | 5th Polypeptide | 1st Polypeptide | 2nd Polypeptide | 3rd Polypeptide |
| 6 | 6th Polypeptide | 4th Polypeptide | 5th Polypeptide | 1st Polypeptide | 3rd Polypeptide | 2nd Polypeptide |
| 6 | 6th Polypeptide | 4th Polypeptide | 5th Polypeptide | 2nd Polypeptide | 1st Polypeptide | 3rd Polypeptide |

-continued

| n | X₁ | X₂ | X₃ | X₄ | X₅ | X₆ |
|---|---|---|---|---|---|---|
| 6 | 6th Polypeptide | 4th Polypeptide | 5th Polypeptide | 2nd Polypeptide | 3rd Polypeptide | 1st Polypeptide |
| 6 | 6th Polypeptide | 4th Polypeptide | 5th Polypeptide | 3rd Polypeptide | 1st Polypeptide | 2nd Polypeptide |
| 6 | 6th Polypeptide | 4th Polypeptide | 5th Polypeptide | 3rd Polypeptide | 2nd Polypeptide | 1st Polypeptide |
| 6 | 6th Polypeptide | 5th Polypeptide | 1st Polypeptide | 2nd Polypeptide | 3rd Polypeptide | 4th Polypeptide |
| 6 | 6th Polypeptide | 5th Polypeptide | 1st Polypeptide | 2nd Polypeptide | 4th Polypeptide | 3rd Polypeptide |
| 6 | 6th Polypeptide | 5th Polypeptide | 1st Polypeptide | 3rd Polypeptide | 2nd Polypeptide | 4th Polypeptide |
| 6 | 6th Polypeptide | 5th Polypeptide | 1st Polypeptide | 3rd Polypeptide | 4th Polypeptide | 2nd Polypeptide |
| 6 | 6th Polypeptide | 5th Polypeptide | 1st Polypeptide | 4th Polypeptide | 2nd Polypeptide | 3rd Polypeptide |
| 6 | 6th Polypeptide | 5th Polypeptide | 1st Polypeptide | 4th Polypeptide | 3rd Polypeptide | 2nd Polypeptide |
| 6 | 6th Polypeptide | 5th Polypeptide | 2nd Polypeptide | 1st Polypeptide | 3rd Polypeptide | 4th Polypeptide |
| 6 | 6th Polypeptide | 5th Polypeptide | 2nd Polypeptide | 1st Polypeptide | 4th Polypeptide | 3rd Polypeptide |
| 6 | 6th Polypeptide | 5th Polypeptide | 2nd Polypeptide | 3rd Polypeptide | 1st Polypeptide | 4th Polypeptide |
| 6 | 6th Polypeptide | 5th Polypeptide | 2nd Polypeptide | 3rd Polypeptide | 4th Polypeptide | 1st Polypeptide |
| 6 | 6th Polypeptide | 5th Polypeptide | 2nd Polypeptide | 4th Polypeptide | 1st Polypeptide | 3rd Polypeptide |
| 6 | 6th Polypeptide | 5th Polypeptide | 2nd Polypeptide | 4th Polypeptide | 3rd Polypeptide | 1st Polypeptide |
| 6 | 6th Polypeptide | 5th Polypeptide | 3rd Polypeptide | 1st Polypeptide | 2nd Polypeptide | 4th Polypeptide |
| 6 | 6th Polypeptide | 5th Polypeptide | 3rd Polypeptide | 1st Polypeptide | 4th Polypeptide | 2nd Polypeptide |
| 6 | 6th Polypeptide | 5th Polypeptide | 3rd Polypeptide | 2nd Polypeptide | 1st Polypeptide | 4th Polypeptide |
| 6 | 6th Polypeptide | 5th Polypeptide | 3rd Polypeptide | 2nd Polypeptide | 4th Polypeptide | 1st Polypeptide |
| 6 | 6th Polypeptide | 5th Polypeptide | 3rd Polypeptide | 4th Polypeptide | 1st Polypeptide | 2nd Polypeptide |
| 6 | 6th Polypeptide | 5th Polypeptide | 3rd Polypeptide | 4th Polypeptide | 2nd Polypeptide | 1st Polypeptide |
| 6 | 6th Polypeptide | 5th Polypeptide | 4th Polypeptide | 1st Polypeptide | 2nd Polypeptide | 3rd Polypeptide |
| 6 | 6th Polypeptide | 5th Polypeptide | 4th Polypeptide | 1st Polypeptide | 3rd Polypeptide | 2nd Polypeptide |
| 6 | 6th Polypeptide | 5th Polypeptide | 4th Polypeptide | 2nd Polypeptide | 1st Polypeptide | 3rd Polypeptide |
| 6 | 6th Polypeptide | 5th Polypeptide | 4th Polypeptide | 2nd Polypeptide | 3rd Polypeptide | 1st Polypeptide |
| 6 | 6th Polypeptide | 5th Polypeptide | 4th Polypeptide | 3rd Polypeptide | 1st Polypeptide | 2nd Polypeptide |
| 6 | 6th Polypeptide | 5th Polypeptide | 4th Polypeptide | 3rd Polypeptide | 2nd Polypeptide | 1st Polypeptide |

Where n is 7, any combination of the first, second, third, fourth, fifth, sixth and seventh polypeptide may be included in any order, as discussed above when n is 2, 3, 4, 5, or 6. The invention also provides a cell (typically a bacterium) which expresses at least two of:

a) a first polypeptide comprising a first amino acid sequence, wherein the first amino acid sequence comprises an amino acid sequence (i) having at least a % sequence identity to SEQ ID NO:1 and/or (ii) consisting of a fragment of at least t contiguous amino acids from SEQ ID NO:1 or from a sequence having at least a % sequence identity to SEQ ID NO:1;

b) a second polypeptide comprising a second amino acid sequence, wherein the second amino acid sequence comprises an amino acid sequence (i) having at least b % sequence identity to SEQ ID NO:2 and/or (ii) consisting of a fragment of at least u contiguous amino acids from SEQ ID NO:2 or from a sequence having at least b % sequence identity to SEQ ID NO:1;

c) a third polypeptide comprising a third amino acid sequence, wherein the third amino acid sequence comprises an amino acid sequence (i) having at least c % sequence identity to SEQ ID NO:3 and/or (ii) consisting of a fragment of at least v contiguous amino acids from SEQ ID NO:3 or from a sequence having at least c % sequence identity to SEQ ID NO:3;

d) a fourth polypeptide comprising a fourth amino acid sequence, wherein the fourth amino acid sequence comprises an amino acid sequence (i) having at least d % sequence identity to SEQ ID NO:4 and/or (ii) consisting of a fragment of at least w contiguous amino acids from SEQ ID NO:4 or from a sequence having at least d % sequence identity to SEQ ID NO:4;

e) a fifth polypeptide comprising a fifth amino acid sequence, wherein the fifth amino acid sequence comprises an amino acid sequence (i) having at least e % sequence identity to SEQ ID NO:5 and/or (ii) consisting of a fragment of at least x contiguous amino acids from SEQ ID NO:5 or from a sequence having at least e % sequence identity to SEQ ID NO:5; and/or f) a sixth polypeptide comprising a sixth amino acid sequence, wherein the sixth amino acid sequence comprises an amino acid sequence (i) having at least f % sequence identity to SEQ ID NO:6 and/or (ii) consisting of a fragment of at least y contiguous amino acids from SEQ ID NO:6 or from a sequence having at least f % sequence identity to SEQ ID NO:6; and/or g) a seventh polypeptide comprising a sixth amino acid sequence, wherein the sixth amino acid sequence comprises an amino acid sequence (i) having at least g % sequence identity to SEQ ID NO:7 and/or (ii) consisting of a fragment of at least z contiguous amino acids from SEQ ID NO:6 or from a sequence having at least g % sequence identity to SEQ ID NO:7

The cell may express 2, 3, 4, 5, 6 or all 7 of the seven amino acid sequences.

The First, Second, Third, Fourth, Fifth, Sixth and Seventh Amino Acid Sequences

The value of a is at least 75 e.g. 80, 85, 90, 92, 94, 95, 96, 97, 98, 99 or more. The value of b is at least 75 e.g. 80, 85, 90, 92, 94, 95, 96, 97, 98, 99 or more. The value of c is at least 75 e.g. 80, 85, 90, 92, 94, 95, 96, 97, 98, 99 or more. The value of d is at least 75 e.g. 80, 85, 90, 92, 94, 95, 96, 97, 98, 99 or more. The value of e is at least 75 e.g. 80, 85, 90, 92, 94, 95, 96, 97, 98, 99 or more. The value of f is at least 75 e.g. 80, 85, 90, 92, 94, 95, 96, 97, 98, 99 or more. The value of g is at least 75 e.g. 80, 85, 90, 92, 94, 95, 96, 97, 98, 99 or more. The values of a, b, c, d, e, f and g may be the same or different. In some embodiments, a b, c, d, e and f are identical. Typically, a, b, c, d, e, f and g are at least 90 e.g. at least 95.

The value of t is at least 7 e.g. 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 225, 250. The value of u is at least 7 e.g. 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 225, 250. The value of v is at least 7 e.g. 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 225, 250. The value of w is at least 7 e.g. 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 225, 250. The value of x is at least 7 e.g. 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 225, 250. The value of y is at least 7 e.g. 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 225, 250. The value of z is at least 7 e.g. 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 225, 250. The values of t, u, v, w, x, y and z may be the same or different. In some embodiments, t, u, v, w, x, y and z are identical.

Fragments preferably comprise an epitope from the respective SEQ ID NO: sequence. Other useful fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of the respective SEQ ID NO: while retaining at least one epitope thereof. Truncation by 20-25 amino acids at the N-terminus is convenient e.g. removal of amino acids 1-29 of any of SEQ ID NOs: 1 to 7 which constitute a leader peptide and/or removal of the C-terminal 35 amino acids of any of SEQ ID NOS:1-7 which constitute an LPXTG (SEQ ID NO:272) anchor.

The GBS59 protein can be split into four domains (D1 to D4) between the end of its leader peptide and the start of its LPXTG (SEQ ID NO:272) anchor. These four domains are as follows in SEQ ID NOs: 1 to 7, and the positions in further GBS59 sequences which correspond to these residues can readily be identified by alignment:

|  | D1 | D2 | D3 | D4 |
|---|---|---|---|---|
| SEQ ID NO: 1 (2603) | 30-175 (SEQ ID NO: 8) | 169-369 (SEQ ID NO: 9) | 363-509 (SEQ ID NO: 10) | 503-670 (SEQ ID NO: 11) |
| SEQ ID NO: 2 (515) | 30-162 (SEQ ID NO: 12) | 156-338 (SEQ ID NO: 13) | 332-499 (SEQ ID NO: 14) | 472-640 (SEQ ID NO: 15) |
| SEQ ID NO: 3 (cjb111) | 30-162 (SEQ ID NO: 16) | 155-337 (SEQ ID NO: 17) | 331-474 (SEQ ID NO: 18) | 468-639 (SEQ ID NO: 19) |
| SEQ ID NO: 4 (h36b) | 30-158 (SEQ ID NO: 20) | 152-350 (SEQ ID NO: 21) | 343-493 (SEQ ID NO: 22) | 487-658 (SEQ ID NO: 23) |
| SEQ ID NO: 5 (CJB110) | 30-172 (SEQ ID NO: 24) | 166-365 (SEQ ID NO: 25) | 359-507 (SEQ ID NO: 26) | 501-669 (SEQ ID NO: 27) |
| SEQ ID NO: 6 (DK21) | 30-168 (SEQ ID NO: 28) | 162-344 (SEQ ID NO: 29) | 338-480 (SEQ ID NO: 30) | 475-647 (SEQ ID NO: 31) |
| SEQ ID NO: 7 (NEM316) | 30-162 (SEQ ID NO: 32) | 155-337 (SEQ ID NO: 33) | 331-474 (SEQ ID NO: 34) | 468-639 (SEQ ID NO: 35) |

Based on protection studies, useful fragments of GBS59 may retain epitopes from at least domain D3. The first, second, third, fourth, fifth, sixth or seventh amino acid sequences used in the immunogenic compositions and polypeptides of the invention may therefore consist of fragments of SEQ ID NOS: 1, 2, 3, 4, 5, 6 or 7 comprising domain D3, as identified above.

Fragments of GBS59 may retain domains D4, D2 and/or D1 in addition to epitopes from domain D3. The first, second, third, fourth, fifth, sixth or seventh amino acid sequences used in the immunogenic compositions and polypeptides of the invention may therefore consist of fragments of SEQ ID NOS: 1, 2, 3, 4, 5, 6 or 7 comprising i) domains D2 and D3; ii) domains D3 and D4; iii) domains D1, D2 and D3; or iv) domains D2, D3 and D4, as identified above.

Sub-fragments of these domains that retain epitopes required for immunogenicity may be used instead of the complete domains, The first, second, third, fourth, fifth, sixth or seventh amino acid sequences used in the immunogenic compositions and polypeptides of the invention may thus consist of fragments of SEQ ID NOS: 1, 2, 3, 4, 5, 6 or 7 comprising sub-fragments of domain D3 (and optionally of domains D1, D3, and/or D4) that retain epitopes required for immunogenicity. Examples of sub-fragments of domains D3 and D4 that may be present in the first, second, third, fourth, fifth, sixth or seventh amino acid sequences used in the immunogenic compositions and polypeptides of the invention are identified below. The sub-fragments of domain D3 identified below (SEQ ID NOs: 36, 38, 40, 42, 44, 46 and 48) are surface-exposed fragments. Smaller epitopes within these surface-exposed fragments can be readily identified by the skilled person and used in the compositions of the invention. For example, two monoclonal antibodies (17C4/A3 and 4H11/B7, SEQ ID NOs: 262-269) have been found to bind an epitope comprising amino acids 411-436 (SEQ ID NO: 270) within the D3 sub-fragment from the 515 clade (SEQ ID NO: 38, fragment of SEQ ID NO: 2). The sub-fragments of domain D4 identified below comprise the two helices (referred to herein as D4H) present at the N-terminal of domain D4 and not the remainder of the D4 domain. These helices are predicted to be surface-exposed.

|  | D3 sub-fragments | D4 sub-fragments (helices) |
|---|---|---|
| SEQ ID NO: 1 (2603) | 363-483 (SEQ ID NO: 36) | 484-588 (SEQ ID NO: 37) |
| SEQ ID NO: 2 (515) | 332-447 (SEQ ID NO: 38) 411-436 (SEQ ID NO: 270) | 448-554 (SEQ ID NO: 39) |

-continued

|  | D3 sub-fragments | D4 sub-fragments (helices) |
|---|---|---|
| SEQ ID NO: 3 (cjb111) | 331-446 (SEQ ID NO: 40) | 447-553 (SEQ ID NO: 41) |
| SEQ ID NO: 4 (h36b) | 343-465 (SEQ ID NO: 42) | 466-572 (SEQ ID NO: 43) |
| SEQ ID NO: 5 (CJB110) | 359-481 (SEQ ID NO: 44) | 482-588 (SEQ ID NO: 45) |
| SEQ ID NO: 6 (DK21) | 338-453 (SEQ ID NO: 46) | 454-561 (SEQ ID NO: 47) |
| SEQ ID NO: 7 (NEM316) | 331-446 (SEQ ID NO: 48) | 447-553 (SEQ ID NO: 49) |

Suitable fragments of SEQ ID NO:1 are SEQ ID NOS:50-53.

Suitable fragments of SEQ ID NO:2 are SEQ ID NOS: 54-57.

Suitable fragments of SEQ ID NO:3 are SEQ ID NOS: 58-61.

Suitable fragments of SEQ ID NO:4 are SEQ ID NOS:62-65.

Suitable fragments of SEQ ID NO:5 are SEQ ID NOS:66-69.

Suitable fragments of SEQ ID NO:6 are SEQ ID NOS:70-73.

Suitable fragments of SEQ ID NO:7 are SEQ ID NOS: 74-77.

These fragments contain combinations of domains D2, D3, and D4 (or D4H) as set out below:

| | D3 + D4 | D3 + D4H | D2 + D3 + D4 | D2 + D3 + D4H |
|---|---|---|---|---|
| SEQ ID NO: 1 (2603) | SEQ ID NO: 50 | SEQ ID NO: 51 | SEQ ID NO: 52 | SEQ ID NO: 53 |
| SEQ ID NO: 2 (515) | SEQ ID NO: 54 | SEQ ID NO: 55 | SEQ ID NO: 56 | SEQ ID NO: 57 |
| SEQ ID NO: 3 (cjb111) | SEQ ID NO: 58 | SEQ ID NO: 59 | SEQ ID NO: 60 | SEQ ID NO: 61 |
| SEQ ID NO: 4 (h36b) | SEQ ID NO: 62 | SEQ ID NO: 63 | SEQ ID NO: 64 | SEQ ID NO: 65 |
| SEQ ID NO: 5 (CJB110) | SEQ ID NO: 66 | SEQ ID NO: 67 | SEQ ID NO: 68 | SEQ ID NO: 69 |
| SEQ ID NO: 6 (DK21) | SEQ ID NO: 70 | SEQ ID NO: 71 | SEQ ID NO: 72 | SEQ ID NO: 73 |
| SEQ ID NO: 7 (NEWM316) | SEQ ID NO: 74 | SEQ ID NO: 75 | SEQ ID NO: 76 | SEQ ID NO: 77 |

In some cases, even smaller fragments may be used. For example, the third amino acid sequence of the invention may consist of a fragment of SEQ ID NO:3 comprising SEQ ID NO:78 (amino acids 411 to 436 of SEQ ID NO:3).

Where fragments are used, the fragment of at least t contiguous amino acids from SEQ ID NO: 1 should not also be present within SEQ ID NO: 2, SEQ ID NO: 3, SEQ ID NO:4, SEQ NO:5, SEQ ID NO:6 nor within SEQ ID NO:7. Similarly, the fragment of at least u contiguous amino acids from SEQ ID NO: 2 should not also be present within SEQ ID NO: 1, SEQ ID NO: 3, SEQ ID NO:4, SEQ ID NO:5, SEQ ID NO:6 nor within SEQ ID NO:7. Similarly, the fragment of at least v contiguous amino acids from SEQ ID NO: 3 should not also be present within SEQ ID NO: 1, SEQ ID NO:2, SEQ ID NO:4, SEQ ID NO:5, SEQ ID NO:6 nor within SEQ ID NO: 7. Similarly, the fragment of at least w contiguous amino acids from SEQ ID NO: 4 should not also be present within SEQ ID NO: 1, SEQ ID NO:2, SEQ ID NO:3, SEQ ID NO:5, SEQ ID NO:6 nor within SEQ ID NO: 7. Similarly, the fragment of at least x contiguous amino acids from SEQ ID NO: 5 should not also be present within SEQ ID NO: 1, SEQ ID NO:2, SEQ ID NO:3, SEQ ID NO:4, SEQ ID NO:6 nor within SEQ ID NO: 7. Similarly, the fragment of at least y contiguous amino acids from SEQ ID NO: 6 should not also be present within SEQ ID NO: 1, SEQ ID NO:2, SEQ ID NO:3, SEQ ID NO:4, SEQ ID NO:5 nor within SEQ ID NO: 7. Similarly, the fragment of at least z contiguous amino acids from SEQ ID NO: 7 should not also be present within SEQ ID NO: 1, SEQ ID NO:2, SEQ ID NO:3, SEQ ID NO:4, SEQ ID NO:5 nor within SEQ ID NO: 6. In some embodiments, when a fragment from one of SEQ ID NOs: 1 to 7 is aligned as a contiguous sequence against the other six SEQ ID NOs, the identity between the fragment and each of the other six SEQ ID NOs is less than 75% e.g. less than 60%, less than 50%, less than 40%, less than 30%.

A polypeptide comprising the first amino acid sequence will, when administered to a subject, elicit an antibody response comprising antibodies that bind to the wild-type GBS protein having amino acid sequence SEQ ID NO: 1 (strain 2603). In some embodiments these antibodies do not bind to the wild-type GBS protein having amino acid sequence SEQ ID NO: 2, the wild-type GBS protein having amino acid sequence SEQ ID NO: 3, the wild-type GBS protein having amino acid sequence SEQ ID NO: 4, the wild-type GBS protein having amino acid sequence SEQ ID NO: 5, the wild-type GBS protein having amino acid sequence SEQ ID NO: 6, or the wild-type GBS protein having amino acid sequence SEQ ID NO: 7.

A polypeptide comprising the second amino acid sequence will, when administered to a subject, elicit an antibody response comprising antibodies that bind to the wild-type GBS protein having amino acid sequence SEQ ID NO: 2 (strain 515). In some embodiments these antibodies do not bind to the wild-type GBS protein having amino acid sequence SEQ ID NO: 1, the wild-type GBS protein having amino acid sequence SEQ ID NO: 3, the wild-type GBS protein having amino acid sequence SEQ ID NO: 4, the wild-type GBS protein having amino acid sequence SEQ ID NO: 5, the wild-type GBS protein having amino acid sequence SEQ ID NO: 6, or the wild-type GBS protein having amino acid sequence SEQ ID NO: 7.

A polypeptide comprising the third amino acid sequence will, when administered to a subject, elicit an antibody response comprising antibodies that bind to the wild-type GBS protein having amino acid sequence SEQ ID NO: 3 (strain cjb111). In some embodiments these antibodies do not bind to the wild-type GBS protein having amino acid sequence SEQ ID NO: 1, the wild-type GBS protein having amino acid sequence SEQ ID NO: 2, the wild-type GBS protein having amino acid sequence SEQ ID NO: 4, the wild-type GBS protein having amino acid sequence SEQ ID NO: 5, the wild-type GBS protein having amino acid sequence SEQ ID NO: 6, or the wild-type GBS protein having amino acid sequence SEQ ID NO: 7.

A polypeptide comprising the fourth amino acid sequence will, when administered to a subject, elicit an antibody response comprising antibodies that bind to the wild-type GBS protein having amino acid sequence SEQ ID NO: 4 (strain h36b). In some embodiments these antibodies do not bind to the wild-type GBS protein having amino acid sequence SEQ ID NO: 1, the wild-type GBS protein having amino acid sequence SEQ ID NO: 2, the wild-type GBS protein having amino acid sequence SEQ ID NO: 3, the wild-type GBS protein having amino acid sequence SEQ ID NO: 5, the wild-type GBS protein having amino acid sequence SEQ ID NO: 6, or the wild-type GBS protein having amino acid sequence SEQ ID NO: 7.

A polypeptide comprising the fifth amino acid sequence will, when administered to a subject, elicit an antibody response comprising antibodies that bind to the wild-type GBS protein having amino acid sequence SEQ ID NO: 5 (strain CJB110). In some embodiments these antibodies do not bind to the wild-type GBS protein having amino acid sequence SEQ ID NO: 1, the wild-type GBS protein having amino acid sequence SEQ ID NO: 2, the wild-type GBS protein having amino acid sequence SEQ ID NO: 3, the wild-type GBS protein having amino acid sequence SEQ ID NO: 4, the wild-type GBS protein having amino acid sequence SEQ ID NO: 6, or the wild-type GBS protein having amino acid sequence SEQ ID NO: 7.

A polypeptide comprising the sixth amino acid sequence will, when administered to a subject, elicit an antibody response comprising antibodies that bind to the wild-type GBS protein having amino acid sequence SEQ ID NO: 6 (strain DK21). In some embodiments these antibodies do not bind to the wild-type GBS protein having amino acid sequence SEQ ID NO: 1, the wild-type GBS protein having amino acid sequence SEQ ID NO: 2, the wild-type GBS protein having amino acid sequence SEQ ID NO: 3, the wild-type GBS protein having amino acid sequence SEQ ID NO: 4, the wild-type GBS protein having amino acid sequence SEQ ID NO: 5, or the wild-type GBS protein having amino acid sequence SEQ ID NO: 7.

A polypeptide comprising the seventh amino acid sequence will, when administered to a subject, elicit an antibody response comprising antibodies that bind to the wild-type GBS protein having amino acid sequence SEQ ID NO: 7 (strain NEM316). In some embodiments these antibodies do not bind to the wild-type GBS protein having amino acid sequence SEQ ID NO: 1, the wild-type GBS protein having amino acid sequence SEQ ID NO: 2, the wild-type GBS protein having amino acid sequence SEQ ID NO: 3, the wild-type GBS protein having amino acid sequence SEQ ID NO: 4, the wild-type GBS protein having amino acid sequence SEQ ID NO: 5, or the wild-type GBS protein having amino acid sequence SEQ ID NO: 6.

Although the first, second, third, fourth, fifth, sixth and seventh amino acid sequences may share some sequences in common, overall they have different amino acid sequences.

Amino acid sequences used with the invention, may, compared to SEQ ID NOs: 1, 2, 3, 4, 5, 6, or 7 or fragments thereof include one or more (e.g. 1, 2, 3, 4, 5, 6, 7, 8, 9, 10, etc.) conservative amino acid replacements i.e. replacements of one amino acid with another which has a related side chain. Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity. The polypeptides may have one or more (e.g. 1, 2, 3, 4, 5, 6, 7, 8, 9, 10, etc.) single amino acid deletions relative to a reference sequence. The polypeptides may also include one or more (e.g. 1, 2, 3, 4, 5, 6, 7, 8, 9, 10, etc.) insertions (e.g. each of 1, 2, 3, 4 or 5 amino acids) relative to a reference sequence.

In particular, the amino acid sequences of the invention may comprise substitutions amino acid residues involved in isopeptide bond formation within GBS59, identified in the table below.

| | Isopeptide bond amino acids in D2 | Isopeptide bond amino acids in D3 | Isopeptide bond amino acids in D4 |
|---|---|---|---|
| 2603 (SEQ ID NO: 1) | K212, N356 | K386, N473 | K499, N666 |
| 515 (SEQ ID NO: 2) | K199, N325 | K355, N437 | K463, N636 |
| CJB111 (SEQ ID NO: 3) | K198, N324 | K354, N436 | K462, N635 |
| H36B (SEQ ID NO: 4) | K195, N336 | K366, N455 | K481, N654 |
| CJB110 (SEQ ID NO: 5) | K209, N352 | K382, N471 | K497, N665 |
| DK21 (SEQ ID NO: 6) | K205, N331 | K361, N443 | K469, N643 |
| NEM316 (SEQ ID NO: 7) | K198, N324 | K354, N436 | K462, N635 |

The data presented in the examples demonstrate that mutation of these residues to disrupt isopeptide bond formation does not adversely affect the immunogenicity of the polypeptide. Accordingly, the polypeptides may comprise substitutions at one or more the lysine residues or asparagine residues recited in the table above. In some embodiments, the lysine residues may be substituted by alanine residues.

A polypeptide used with the invention may comprise an amino acid sequence that:
  (a) is identical (i.e. 100% identical) to SEQ ID NO: 1, 2, 3, 4, 5, 6 or 7, or is identical to a SEQ ID NO: 1, 2, 3, 4, 5, 6 or 7;
  (b) shares sequence identity with SEQ ID NO: 1, 2, 3, 4, 5, 6 or 7, or shares identity with a fragment of SEQ ID NO:1, 2, 3, 4, 5, 6 or 7;
  (c) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and
  (d) when aligned SEQ ID 1, 2, 3, 4, 5, 6 or 7 using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [3], using default parameters (e.g. with Gap opening penalty=10.0, and with Gap extension penalty=0.5, using the EBLOSUM62 scoring matrix). This algorithm is conveniently implemented in the needle tool in the EMBOSS package [4].

Within group (c), deletions or substitutions may be at the N-terminus and/or C-terminus, or may be between the two termini. Thus a truncation is an example of a deletion. Truncations may involve deletion of up to 40 (or more) amino acids at the N-terminus and/or C-terminus.

Hybrid Polypeptides

Different GBS59 clades used in the invention do not have to be present as separate polypeptides but can instead be expressed as a single polypeptide chain (a 'hybrid' polypeptide or 'chimera'). Hybrid polypeptides offer two main advantages: first, a polypeptide that may be unstable or poorly expressed on its own can be assisted by adding a suitable hybrid partner that overcomes the problem; second, commercial manufacture is simplified as only one expression and purification need to be employed in order to produce two polypeptides which are both antigenically useful.

Hybrid polypeptides can include sequences from only GBS59 antigens but in other embodiments can include non-GBS59 antigens (usually non-GBS59 antigens from GBS), such as other pilus subunits. If non-GBS59 antigens are present these may be to the N-terminus of any 2, 3, 4, 5, 6 or 7 GBS59 sequences, to the C-terminus of any 2, 3, 4, 5, 6 or 7 GBS59 sequences, or may be between two GBS59 sequences in a hybrid polypeptide containing 2, 3, 4, 5, 6 or 7 GBS59 sequences.

Different hybrid polypeptides may be mixed together in a single formulation. Hybrids may be combined with non-hybrid GBS59 antigens or other non-GBS59 antigens.

Hybrid polypeptides may be represented by the formula $NH_2$-A-$\{$—X-L-$\}_n$-B—COOH.

If a —X— moiety has a leader peptide sequence in its wild-type form, this may be included or omitted in the hybrid protein. In some embodiments, the leader peptides will be deleted except for that of the —X— moiety located at the N-terminus of the hybrid protein i.e. the leader peptide of $X_1$ will be retained, but the leader peptides of $X_2 \ldots X_n$ will be omitted. This is equivalent to deleting all leader peptides and using the leader peptide of $X_1$ as moiety -A-.

For each n instances of $\{$—X-L-$\}$, linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s) -L- will typically be short (e.g. 20 or fewer amino acids i.e. 20, 19, 18, 17, 16, 15, 14, 13, 12, 11, 10, 9, 8, 7, 6, 5, 4, 3, 2, 1). Examples comprise short peptide sequences which facilitate cloning, poly-glycine linkers (i.e. comprising $Gly_n$ where n=2, 3, 4, 5, 6, 7, 8, 9, 10 or more), and histidine tags (i.e. His where n=3, 4, 5, 6, 7, 8, 9, 10 or more, e.g. SEQ ID NO:79). Other suitable linker amino acid sequences will be apparent to those skilled in the art. Useful linkers are GSGS (SEQ ID NO:80), GSGGGG (SEQ ID NO: 81) or GSGSGGGG (SEQ ID NO: 82), with the Gly-Ser dipeptide being formed from a BamHI restriction site, thus aiding cloning and manipulation, and the $(Gly)_4$ tetrapeptide being a typical poly-glycine linker. Other suitable linkers, particularly for use as the final $L_n$ are a Leu-Glu dipeptide or Gly-Ser. Linkers will usually contain at least one glycine residue to facilitate structural flexibility e.g. a -L- moiety may contain 1, 2, 3, 4, 5, 6, 7, 8, 9, 10 or more glycine residues. Such glycines may be arranged to include at least two consecutive glycines in a Gly-Gly dipeptide sequence, or a longer oligo-Gly sequence i.e. $Gly_n$ where n=2, 3, 4, 5, 6, 7, 8, 9, 10 or more.

-A- is an optional N-terminal amino acid sequence. This will typically be short (e.g. 40 or fewer amino acids i.e. 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. His where n=3, 4, 5, 6, 7, 8, 9, 10 or more). Other suitable N-terminal amino acid sequences will be apparent to those skilled in the art. If $X_1$ lacks its own N-terminus methionine, -A- is preferably an oligopeptide (e.g. with 1, 2, 3, 4, 5, 6, 7 or 8 amino acids) which provides a N-terminus methionine e.g. Met-Ala-Ser, or a single Met residue. In a nascent polypeptide the -A- moiety can provide the polypeptide's N-terminal methionine (formyl-methionine, fMet, in bacteria). One or more amino acids may be cleaved from the N-terminus of a nascent -A- moiety, however, such that the -A- moiety in a mature polypeptide of the invention does not necessarily include a N-terminal methionine.

—B— is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. His where n=3, 4, 5, 6, 7, 8, 9, 10 or more, such as SEQ ID NO: 79), or sequences which enhance protein stability. Other suitable C-terminal amino acid sequences will be apparent to those skilled in the art, such as a glutathione-S-transferase, thioredoxin, 14 kDa fragment of *S. aureus* protein A, a biotinylated peptide, a maltose-binding protein, an enterokinase flag, etc.

It is preferred that -A-, —B— and -L- sequences do not include a sequence that shares 10 or more contiguous amino acids in common with a human polypeptide sequence.

In some embodiments, a -L- moiety comprises a non-GBS59 antigen. In some embodiments, the -A- moiety comprises a non-GBS59 antigen, and in some the —B— moiety comprises a non-GBS59 antigen.

The invention also provides nucleic acid which encodes a hybrid polypeptide of the invention.

Of the various X and L moieties, useful combinations include, but are not limited to:

| SEQ ID | X1* | L1* | X2* | L2* | X3* | L3 | X4 | L4 | X5 | L5 | X6 |
|---|---|---|---|---|---|---|---|---|---|---|---|
| 83 (Fusion E) | 38 D3 frag 515 | 80 | 42 D3 frag h36b | 80 | 40 D3 frag cjb111 | 80 | 36 D3 frag 2603 | 80 | 44 D3 fragCJB110 | 80 | 46 D3 fragDK21 |
| 84 (Fusion F) | 55 D3 + D4H 515 | 80 | 59 D3 + D4H cjb111 | 80 | 67 D3 + D4H CJB110 | 80 | 51 D3 + D4H 2603 | 80 | 63 D3 + D4H h36b | 80 | 71 D3 + D4H DK21 |
| 85 (Fusion G) | 51 D3 + D4H 2603 | 80 | 55 D3 + D4H 515 | 80 | 63 D3 + D4H h36b | 80 | 59 D3 + D4H cjb111 | — | — | — | — |
| 86 (Fusion H) | 59 D3 + D4H cjb111 | 80 | 63 D3 + D4H h36b | 80 | 51 D3 + D4H 2603 | 80 | 55 D3 + D4H 515 | — | — | — | — |
| 87 (Fusion I) | 57 D2 + D3 + D4H 515 | 80 | 53 D2 + D3 + D4H 2603 | 80 | 61 D2 + D3 + D4H cjb111 | 80 | — | — | — | — | — |

*Number indicates SEQ ID NO:

* Number indicates SEQ ID NO:

Thus examples of hybrids of the invention include polypeptides comprising an amino acid sequence selected from the group consisting of: SEQ ID NO: 83; SEQ ID NO: 84; SEQ ID NO: 85; SEQ ID NO: 86; or SEQ ID NO: 87.

The invention provides a polypeptide comprising an amino acid sequence having at least i % sequence identity to any one of SEQ ID NOs: 83, 84, 85, 86, or 87. The value of i may be selected from 50, 60, 70, 80, 85, 90, 95, 96, 97, 98, 99 or more.

In some embodiments, the polypeptide comprising an amino acid sequence selected from the group consisting of: SEQ ID NO: 83; SEQ ID NO: 84; SEQ ID NO: 85; SEQ ID NO: 86; or SEQ ID NO: 87, or having at least i % sequence identity to any one of SEQ ID NO: 83; SEQ ID NO: 84; SEQ ID NO: 85; SEQ ID NO: 86; or SEQ ID NO: 87 may comprise a single N-terminal Methionine residue (i.e. A=Met).

Polypeptides

Polypeptides used with the invention can be prepared in many ways e.g. by chemical synthesis (in whole or in part), by digesting longer polypeptides using proteases, by translation from RNA, by purification from cell culture (e.g. from recombinant expression), from the organism itself (e.g. after bacterial culture, or direct from patients), etc. A preferred method for production of peptides <40 amino acids long involves in vitro chemical synthesis [5,6]. Solid-phase peptide synthesis is particularly preferred, such as methods based on tBoc or Fmoc [7] chemistry. Enzymatic synthesis [8] may also be used in part or in full. As an alternative to chemical synthesis, biological synthesis may be used e.g. the polypeptides may be produced by translation. This may be carried out in vitro or in vivo. Biological methods are in general restricted to the production of polypeptides based on L-amino acids, but manipulation of translation machinery (e.g. of aminoacyl tRNA molecules) can be used to allow the introduction of D-amino acids (or of other non natural amino acids, such as iodotyrosine or methylphenylalanine, azidohomoalanine, etc.) [9]. Where D-amino acids are included, however, it is preferred to use chemical synthesis. Polypeptides may have covalent modifications at the C-terminus and/or N-terminus.

Polypeptides can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.).

Polypeptides are preferably provided in purified or substantially purified form i.e. substantially free from other polypeptides (e.g. free from naturally-occurring polypeptides), particularly from other pneumococcal or host cell polypeptides, and are generally at least about 50% pure (by weight), and usually at least about 90% pure i.e. less than about 50%, and more preferably less than about 10% (e.g. 5% or less) of a composition is made up of other expressed polypeptides.

Polypeptides may be attached to a solid support. Polypeptides may comprise a detectable label (e.g. a radioactive or fluorescent label, or a biotin label).

The term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. Polypeptides can occur as single chains or associated chains. Polypeptides can be naturally or non-naturally glycosylated (i.e. the polypeptide has a glycosylation pattern that differs from the glycosylation pattern found in the corresponding naturally occurring polypeptide).

The invention provides a process for producing polypeptides of the invention, comprising culturing a host cell of to the invention under conditions which induce polypeptide expression. Although expression of the polypeptide may take place in a *Streptococcus*, the invention will usually use a heterologous host for expression. The heterologous host may be prokaryotic (e.g. a bacterium) or eukaryotic. It will usually be *E. coli*, but other suitable hosts include *Bacillus subtilis, Vibrio cholerae, Salmonella typhi, Salmonella typhimurium, Neisseria lactamica, Neisseria cinerea, Mycobacteria* (e.g. *M. tuberculosis*), yeasts, etc.

The invention also provides a process for producing a polypeptide of the invention, wherein the polypeptide is synthesised in part or in whole using chemical means.

The invention also provides a composition comprising two or more polypeptides of the invention.

Nucleic Acids

The invention also provides a nucleic acid comprising a nucleotide sequence encoding a hybrid polypeptide of the invention. For example, the invention provides a nucleic acid comprising a nucleotide sequence encoding a hybrid polypeptide comprising an amino acid sequence selected from the group consisting of: SEQ ID NO: 83; SEQ ID NO: 84; SEQ ID NO: 85; SEQ ID NO: 86; or SEQ ID NO: 87. The invention thus provides a nucleic acid comprising a nucleotide sequence selected from the group consisting of: SEQ ID NO:88 (encoding the polypeptide of SEQ ID NO:83), SEQ ID NO: 89 (encoding the polypeptide of SEQ ID NO:84); SEQ ID NO: 90 (encoding the polypeptide of SEQ ID NO:85); SEQ ID NO: 91 (encoding the polypeptide of SEQ ID NO:86); or SEQ ID NO: 92 (encoding the polypeptide of SEQ ID NO:87).

The invention also provides nucleic acid comprising nucleotide sequences having sequence identity to such nucleotide sequences. Such nucleic acids include those using alternative codons to encode the same amino acid. In particular, nucleic acids may contain alternative codons optimised for expression in specific microorganisms. The invention thus provides a nucleic acid sequence comprising a nucleotide sequence encoding a hybrid polypeptide comprising an amino acid sequence selected from the group consisting of: SEQ ID NO: 83; SEQ ID NO: 84; SEQ ID NO: 85; SEQ ID NO: 86; or SEQ ID NO: 87 that has been optimised for expression in *E. coli*. The invention thus provides a nucleic acid comprising a nucleotide sequence selected from the group consisting of: SEQ ID NO:93 (*E. coli* optimised sequence encoding the polypeptide of SEQ ID NO:83), SEQ ID NO: 94 (*E. coli* optimised sequence encoding the polypeptide of SEQ ID NO:84); SEQ ID NO: 95 (*E. coli* optimised sequence encoding the polypeptide of SEQ ID NO:85); SEQ ID NO: 96 (*E. coli* optimised sequence encoding the polypeptide of SEQ ID NO:86); or SEQ ID NO: 97 (*E. coli* optimised sequence encoding the polypeptide of SEQ ID NO:87).

The invention also provides nucleic acid which can hybridize to these nucleic acids. Hybridization reactions can be performed under conditions of different "stringency". Conditions that increase stringency of a hybridization reaction of widely known and published in the art. Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×

SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art [e.g. see refs 10 & 223, etc.].

The invention includes nucleic acid comprising sequences complementary to these sequences (e.g. for antisense or probing, or for use as primers).

Nucleic acid according to the invention can take various forms (e.g. single-stranded, double-stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other GBS or host cell nucleic acids, generally being at least about 50% pure (by weight), and usually at least about 90% pure. Nucleic acids of the invention are preferably GBS nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labelled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Preferred vectors are plasmids. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T).

Nucleic acids of the invention can be used, for example: to produce polypeptides in vitro or in vivo; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesised in part or in whole using chemical means.

The invention provides vectors comprising nucleotide sequences of the invention (e.g. cloning or expression vectors) and host cells transformed with such vectors.

Immunogenic Compositions

Mixtures and hybrid polypeptides of the invention are useful as active ingredients in immunogenic compositions. Such immunogenic compositions may be useful as vaccines. These vaccines may either be prophylactic (i.e. to prevent infection) or therapeutic (i.e. to treat infection), but will typically be prophylactic.

Compositions may thus be pharmaceutically acceptable. They will usually include components in addition to the antigens e.g. they typically include one or more pharmaceutical carrier(s) and/or excipient(s). A thorough discussion of such components is available in reference [218].

Compositions will generally be administered to a mammal in aqueous form. Prior to administration, however, the composition may have been in a non-aqueous form. For instance, although some vaccines are manufactured in aqueous form, then filled and distributed and administered also in aqueous form, other vaccines are lyophilised during manufacture and are reconstituted into an aqueous form at the time of use. Thus a composition of the invention may be dried, such as a lyophilised formulation.

The composition may include preservatives such as thiomersal or 2-phenoxyethanol. It is preferred, however, that the vaccine should be substantially free from (i.e. less than 5 μg/ml) mercurial material e.g. thiomersal-free. Vaccines containing no mercury are more preferred. Preservative-free vaccines are particularly preferred.

To control tonicity, it is preferred to include a physiological salt, such as a sodium salt. Sodium chloride (NaCl) is preferred, which may be present at between 1 and 20 mg/ml e.g. about 10+2 mg/ml NaCl. Other salts that may be present include potassium chloride, potassium dihydrogen phosphate, disodium phosphate dehydrate, magnesium chloride, calcium chloride, etc.

Compositions will generally have an osmolality of between 200 mOsm/kg and 400 mOsm/kg, preferably between 240-360 mOsm/kg, and will more preferably fall within the range of 290-310 mOsm/kg.

Compositions may include one or more buffers. Typical buffers include: a phosphate buffer; a Tris buffer; a borate buffer; a succinate buffer; a histidine buffer (particularly with an aluminum hydroxide adjuvant); or a citrate buffer. Buffers will typically be included in the 5-20 mM range.

The pH of a composition will generally be between 5.0 and 8.1, and more typically between 6.0 and 8.0 e.g. 6.5 and 7.5, or between 7.0 and 7.8.

The composition is preferably sterile. The composition is preferably non-pyrogenic e.g. containing <1 EU (endotoxin unit, a standard measure) per dose, and preferably <0.1 EU per dose. The composition is preferably gluten free.

The composition may include material for a single immunisation, or may include material for multiple immunisations (i.e. a 'multidose' kit). The inclusion of a preservative is preferred in multidose arrangements. As an alternative (or in addition) to including a preservative in multidose compositions, the compositions may be contained in a container having an aseptic adaptor for removal of material.

Human vaccines are typically administered in a dosage volume of about 0.5 ml, although a half dose (i.e. about 0.25 ml) may be administered to children.

Immunogenic compositions of the invention may also comprise one or more immunoregulatory agents. Preferably, one or more of the immunoregulatory agents include one or more adjuvants. The adjuvants may include a TH1 adjuvant and/or a TH2 adjuvant, further discussed below.

Adjuvants which may be used in compositions of the invention include, but are not limited to:

A. Mineral-Containing Compositions

Mineral containing compositions suitable for use as adjuvants in the invention include mineral salts, such as aluminium salts and calcium salts. The invention includes mineral salts such as hydroxides (e.g. oxyhydroxides), phosphates (e.g. hydroxyphosphates, orthophosphates), sulphates, etc. [e.g. see chapters 8 & 9 of ref 11], or mixtures of different mineral compounds, with the compounds taking any suitable form (e.g. gel, crystalline, amorphous, etc.), and with adsorption being preferred. The mineral containing compositions may also be formulated as a particle of metal salt.

The adjuvants known as "aluminium hydroxide" are typically aluminium oxyhydroxide salts, which are usually at least partially crystalline. Aluminium oxyhydroxide, which can be represented by the formula AlO(OH), can be distinguished from other aluminium compounds, such as aluminium hydroxide Al(OH)$_3$, by infrared (IR) spectroscopy, in particular by the presence of an adsorption band at 1070 cm$^{-1}$ and a strong shoulder at 3090-3100 cm$^{-1}$ [chapter 9 of ref. 11]. The degree of crystallinity of an aluminium hydroxide adjuvant is reflected by the width of the diffraction band at half height (WHH), with poorly-crystalline particles showing greater line broadening due to smaller crystallite sizes. The surface area increases as WHH increases, and adjuvants with higher WHH values have been seen to have greater capacity for antigen adsorption. A fibrous morphology (e.g. as seen in transmission electron micrographs) is typical for aluminium hydroxide adjuvants. The pI of aluminium hydroxide adjuvants is typically about 11 i.e. the adjuvant itself has a positive surface charge at physiological pH. Adsorptive capacities of between 1.8-2.6 mg protein per mg Al$^{+++}$ at pH 7.4 have been reported for aluminium hydroxide adjuvants.

The adjuvants known as "aluminium phosphate" are typically aluminium hydroxyphosphates, often also containing a small amount of sulfate (i.e. aluminium hydroxyphosphate sulfate). They may be obtained by precipitation, and the reaction conditions and concentrations during precipitation influence the degree of substitution of phosphate for hydroxyl in the salt. Hydroxyphosphates generally have a PO$_4$/Al molar ratio between 0.3 and 1.2. Hydroxyphosphates can be distinguished from strict AlPO$_4$ by the presence of hydroxyl groups. For example, an IR spectrum band at 3164 cm$^{-1}$ (e.g. when heated to 200° C.) indicates the presence of structural hydroxyls [ch. 9 of ref 11].

The PO$_4$/Al$^{3+}$ molar ratio of an aluminium phosphate adjuvant will generally be between 0.3 and 1.2, preferably between 0.8 and 1.2, and more preferably 0.95±0.1. The aluminium phosphate will generally be amorphous, particularly for hydroxyphosphate salts. A typical adjuvant is amorphous aluminium hydroxyphosphate with PO$_4$/Al molar ratio between 0.84 and 0.92, included at 0.6 mg Al$^{3+}$/ml. The aluminium phosphate will generally be particulate (e.g. plate-like morphology as seen in transmission electron micrographs). Typical diameters of the particles are in the range 0.5-20 µm (e.g. about 5-10 µm) after any antigen adsorption. Adsorptive capacities of between 0.7-1.5 mg protein per mg Al$^{+++}$ at pH 7.4 have been reported for aluminium phosphate adjuvants.

The point of zero charge (PZC) of aluminium phosphate is inversely related to the degree of substitution of phosphate for hydroxyl, and this degree of substitution can vary depending on reaction conditions and concentration of reactants used for preparing the salt by precipitation. PZC is also altered by changing the concentration of free phosphate ions in solution (more phosphate=more acidic PZC) or by adding a buffer such as a histidine buffer (makes PZC more basic). Aluminium phosphates used according to the invention will generally have a PZC of between 4.0 and 7.0, more preferably between 5.0 and 6.5 e.g. about 5.7.

Suspensions of aluminium salts used to prepare compositions of the invention may contain a buffer (e.g. a phosphate or a histidine or a Tris buffer), but this is not always necessary. The suspensions are preferably sterile and pyrogen-free. A suspension may include free aqueous phosphate ions e.g. present at a concentration between 1.0 and 20 mM, preferably between 5 and 15 mM, and more preferably about 10 mM. The suspensions may also comprise sodium chloride.

In one embodiment, an adjuvant component includes a mixture of both an aluminium hydroxide and an aluminium phosphate. In this case there may be more aluminium phosphate than hydroxide e.g. a weight ratio of at least 2:1 e.g. ≥5:1, ≥6:1, ≥7:1, ≥8:1, ≥9:1, etc.

The concentration of Al$^{+++}$ in a composition for administration to a patient is preferably less than 10 mg/ml e.g. ≤5 mg/ml, ≤4 mg/ml, ≤3 mg/ml, ≤2 mg/ml, ≤1 mg/ml, etc. A preferred range is between 0.3 and 1 mg/ml. A maximum of <0.85 mg/dose is preferred.

B. Oil Emulsions

Oil emulsion compositions suitable for use as adjuvants in the invention include squalene-water emulsions, such as MF59® [Chapter 10 of ref 11; see also ref. 12] (5% squalene, 0.5% TWEEN® 80, and 0.5% SPAN® 85, formulated into submicron particles using a microfluidizer). Complete Freund's adjuvant (CFA) and incomplete Freund's adjuvant (IFA) may also be used.

Various suitable oin-in-water emulsions are known, and they typically include at least one oil and at least one surfactant, with the oil(s) and surfactant(s) being biodegradable (metabolisable) and biocompatible. The oil droplets in the emulsion are generally less than 5 µm in diameter, and advantageously the emulsion comprises oil droplets with a submicron diameter, with these small sizes being achieved with a microfluidiser to provide stable emulsions. Droplets with a size less than 220 nm are preferred as they can be subjected to filter sterilization.

The invention can be used with oils such as those from an animal (such as fish) or vegetable source. Sources for vegetable oils include nuts, seeds and grains. Peanut oil, soybean oil, coconut oil, and olive oil, the most commonly available, exemplify the nut oils. Jojoba oil can be used e.g. obtained from the jojoba bean. Seed oils include safflower oil, cottonseed oil, sunflower seed oil, sesame seed oil and the like. In the grain group, corn oil is the most readily available, but the oil of other cereal grains such as wheat, oats, rye, rice, teff, triticale and the like may also be used. 6-10 carbon fatty acid esters of glycerol and 1,2-propanediol, while not occurring naturally in seed oils, may be prepared by hydrolysis, separation and esterification of the appropriate materials starting from the nut and seed oils. Fats and oils from mammalian milk are metabolizable and may therefore be used in the practice of this invention. The procedures for separation, purification, saponification and other means necessary for obtaining pure oils from animal sources are well known in the art. Most fish contain metabolizable oils which may be readily recovered. For example, cod liver oil, shark liver oils, and whale oil such as spermaceti exemplify several of the fish oils which may be used herein. A number of branched chain oils are synthesized biochemically in 5-carbon isoprene units and are generally referred to as terpenoids. Shark liver oil contains a branched, unsaturated terpenoid known as squalene, 2,6,10,15,19,23-hexamethyl-2,6,10,14,18,22-tetracosahexaene. Other preferred oils are the tocopherols (see below). Oil in water emulsions comprising sqlauene are particularly preferred. Mixtures of oils can be used.

Surfactants can be classified by their 'HLB' (hydrophile/lipophile balance). Preferred surfactants of the invention have a HLB of at least 10, preferably at least 15, and more preferably at least 16. The invention can be used with surfactants including, but not limited to: the polyoxyethylene sorbitan esters surfactants (commonly referred to as the Tweens), especially polysorbate 20 and polysorbate 80; copolymers of ethylene oxide (EO), propylene oxide (PO), and/or butylene oxide (BO), sold under the DOWFAX™ tradename, such as linear EO/PO block copolymers; octoxynols, which can vary in the number of repeating ethoxy (oxy-1,2-ethanediyl) groups, with octoxynol-9 (TRITON® X-100, or t-octylphenoxypolyethoxyethanol) being of particular interest; (octylphenoxy)polyethoxyethanol (IGEPAL CA-630/NP-40); phospholipids such as phosphatidylcholine (lecithin); polyoxyethylene fatty ethers derived from lauryl, cetyl, stearyl and oleyl alcohols (known as BRIJ® surfactants), such as triethyleneglycol monolauryl ether (BRIJ® 30); and sorbitan esters (commonly known as the SPANs), such as sorbitan trioleate (SPAN® 85) and sorbitan monolaurate. Preferred surfactants for including in the emulsion are TWEEN® 80 (polyoxyethylene sorbitan monooleate), SPAN® 85 (sorbitan trioleate), lecithin and TRITON® X-100. As mentioned above, detergents such as Tween 80 may contribute to the thermal stability seen in the examples below.

Mixtures of surfactants can be used e.g. TWEEN® 80/SPAN® 85 mixtures. A combination of a polyoxyethylene sorbitan ester such as polyoxyethylene sorbitan monooleate (TWEEN® 80) and an octoxynol such as t-octylphenoxypolyethoxyethanol (TRITON® X-100) is also suitable. Another useful combination comprises laureth 9 plus a polyoxyethylene sorbitan ester and/or an octoxynol.

Preferred amounts of surfactants (% by weight) are: polyoxyethylene sorbitan esters (such as TWEEN® 80) 0.01 to 1%, in particular about 0.1%; octyl- or nonylphenoxy polyoxyethanols (such as TRITON® X-100, or other detergents in the TRITON® series) 0.001 to 0.1%, in particular 0.005 to 0.02%; polyoxyethylene ethers (such as laureth 9) 0.1 to 20%, preferably 0.1 to 10% and in particular 0.1 to 1% or about 0.5%.

Specific oil-in-water emulsion adjuvants useful with the invention include, but are not limited to:

A submicron emulsion of squalene, Tween 80, and Span 85. The composition of the emulsion by volume can be about 5% squalene, about 0.5% polysorbate 80 and about 0.5% SPAN® 85. In weight terms, these ratios become 4.3% squalene, 0.5% polysorbate 80 and 0.48% SPAN® 85. This adjuvant is known as 'MF59®' [13-15], as described in more detail in Chapter 10 of ref. 16 and chapter 12 of ref. 17. The MF59® emulsion advantageously includes citrate ions e.g. 10 mM sodium citrate buffer.

An emulsion comprising squalene, an α-tocopherol, and polysorbate 80. These emulsions may have from 2 to 10% squalene, from 2 to 10% tocopherol and from 0.3 to 3% TWEEN® 80, and the weight ratio of squalene: tocopherol is preferably ≤1 (e.g. 0.90) as this provides a more stable emulsion. Squalene and TWEEN® 80 may be present volume ratio of about 5:2, or at a weight ratio of about 11:5. One such emulsion can be made by dissolving TWEEN® 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm.

An emulsion of squalene, a tocopherol, and a TRITON® detergent (e.g. TRITON® X-100). The emulsion may also include a 3d-MPL® (see below). The emulsion may contain a phosphate buffer.

An emulsion comprising a polysorbate (e.g. polysorbate 80), a TRITON® detergent (e.g. TRITON® X-100) and a tocopherol (e.g. an α-tocopherol succinate). The emulsion may include these three components at a mass ratio of about 75:11:10 (e.g. 750 m/ml polysorbate 80, 110 m/ml TRITON® X-100 and 100 m/ml α-tocopherol succinate), and these concentrations should include any contribution of these components from antigens. The emulsion may also include squalene. The emulsion may also include a 3d-MPL (see below). The aqueous phase may contain a phosphate buffer.

An emulsion of squalane, polysorbate 80 and poloxamer 401 ("PLURONIC® L121"). The emulsion can be formulated in phosphate buffered saline, pH 7.4. This emulsion is a useful delivery vehicle for muramyl dipeptides, and has been used with threonyl-MDP in the "SAF-1" adjuvant [18] (0.05-1% Thr-MDP, 5% squalane, 2.5% PLURONIC® L121 and 0.2% polysorbate 80). It can also be used without the Thr-MDP, as in the "AF" adjuvant [19] (5% squalene, 1.25% PLURONIC® L121 and 0.2% polysorbate 80). Microfluidisation is preferred.

An emulsion comprising squalene, an aqueous solvent, a polyoxyethylene alkyl ether hydrophilic nonionic surfactant (e.g. polyoxyethylene (12) cetostearyl ether) and a hydrophobic nonionic surfactant (e.g. a sorbitan ester or mannide ester, such as sorbitan monoleate or 'SPAN® 80'). The emulsion is preferably thermoreversible and/or has at least 90% of the oil droplets (by volume) with a size less than 200 nm [20]. The emulsion may also include one or more of: alditol; a cryoprotective agent (e.g. a sugar, such as dodecylmaltoside and/or sucrose); and/or an alkylpolyglycoside. Such emulsions may be lyophilized.

An emulsion having from 0.5-50% of an oil, 0.1-10% of a phospholipid, and 0.05-5% of a non-ionic surfactant. As described in reference 21, preferred phospholipid components are phosphatidylcholine, phosphatidylethanolamine, phosphatidylserine, phosphatidylinositol, phosphatidylglycerol, phosphatidic acid, sphingomyelin and cardiolipin. Submicron droplet sizes are advantageous.

A submicron oil-in-water emulsion of a non-metabolisable oil (such as light mineral oil) and at least one surfactant (such as lecithin, TWEEN® 80 or SPAN® 80). Additives may be included, such as QuilA saponin, cholesterol, a saponin-lipophile conjugate (such as GPI-0100, described in reference 22, produced by addition of aliphatic amine to desacylsaponin via the carboxyl group of glucuronic acid), dimethyldioctadecylammonium bromide and/or N,N-dioctadecyl-N,N-bis (2-hydroxyethyl)propanediamine.

An emulsion comprising a mineral oil, a non-ionic lipophilic ethoxylated fatty alcohol, and a non-ionic hydrophilic surfactant (e.g. an ethoxylated fatty alcohol and/or polyoxyethylene-polyoxypropylene block copolymer) [23].

An emulsion comprising a mineral oil, a non-ionic hydrophilic ethoxylated fatty alcohol, and a non-ionic lipophilic surfactant (e.g. an ethoxylated fatty alcohol and/or polyoxyethylene-polyoxypropylene block copolymer) [23].

An emulsion in which a saponin (e.g. QuilA or QS21) and a sterol (e.g. a cholesterol) are associated as helical micelles [24].

Antigens and adjuvants in a composition will typically be in admixture at the time of delivery to a patient. The emulsions may be mixed with antigen during manufacture, or extemporaneously, at the time of delivery. Thus the adjuvant and antigen may be kept separately in a packaged or distributed vaccine, ready for final formulation at the time of use. The antigen will generally be in an aqueous form, such that the vaccine is finally prepared by mixing two liquids. The volume ratio of the two liquids for mixing can vary (e.g. between 5:1 and 1:5) but is generally about 1:1.

C. Saponin Formulations [Chapter 22 of Ref. 11]

Saponin formulations may also be used as adjuvants in the invention. Saponins are a heterogeneous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™.

Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref. 25. Saponin formulations may also comprise a sterol, such as cholesterol [26].

Combinations of saponins and cholesterols can be used to form unique particles called immunostimulating complexes (ISCOMs) [chapter 23 of ref. 11]. ISCOMs typically also include a phospholipid such as phosphatidylethanolamine or phosphatidylcholine. Any known saponin can be used in ISCOMs. Preferably, the ISCOM includes one or more of QuilA, QHA & QHC. ISCOMs are further described in refs. 26-28. Optionally, the ISCOMS may be devoid of additional detergent [29].

A review of the development of saponin based adjuvants can be found in refs. 30 & 31.

D. Virosomes and Virus-Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in refs. 32-37. Virosomes are discussed further in, for example, ref. 38

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof.

Non-toxic derivatives of LPS include monophosphoryl lipid A (MPL®) and 3-O-deacylated MPL® (3dMPL®). 3dMPL® is a mixture of 3 de-O-acylated monophosphoryl lipid A with 4, 5 or 6 acylated chains. A preferred "small particle" form of 3 De-O-acylated monophosphoryl lipid A is disclosed in ref. 39. Such "small particles" of 3dMPL® are small enough to be sterile filtered through a 0.22 μm membrane[39]. Other non-toxic LPS derivatives include monophosphoryl lipid A mimics, such as aminoalkyl glucosaminide phosphate derivatives e.g. RC-529 [40, 41].

Lipid A derivatives include derivatives of lipid A from *Escherichia coli* such as OM-174. OM-174 is described for example in refs. 42 & 43.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 44, 45 and 46 disclose possible analog substitutions e.g. replacement of guanosine with 2'-deoxy-7-deazaguanosine. The adjuvant effect of CpG oligonucleotides is further discussed in refs. 47-52.

The CpG sequence may be directed to TLR9, such as the motif GTCGTT or TTCGTT [53]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 54-56. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, refs. 53 & 57-59.

A particularly useful adjuvant based around immunostimulatory oligonucleotides is known as IC-31™ [60]. Thus an adjuvant used with the invention may comprise a mixture of (i) an oligonucleotide (e.g. between 15-40 nucleotides) including at least one (and preferably multiple) CpI motifs (i.e. a cytosine linked to an inosine to form a dinucleotide), and (ii) a polycationic polymer, such as an oligopeptide (e.g. between 5-20 amino acids) including at least one (and preferably multiple) Lys-Arg-Lys tripeptide sequence(s). The oligonucleotide may be a deoxynucleotide comprising 26-mer sequence 5'-(IC)$_{13}$-3' (SEQ ID NO: 98). The polycationic polymer may be a peptide comprising 11-mer amino acid sequence KLKLLLLLKLK (SEQ ID NO:99).

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in ref 61 and as parenteral adjuvants in ref. 62. The toxin or toxoid is preferably in the form of a holo-toxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in refs. 63-70. A useful CT mutant is or CT-E29H [71]. Numerical reference for amino acid substitutions is preferably based on the alignments of the A and B subunits of ADP-ribosylating toxins set forth in ref. 72, specifically incorporated herein by reference in its entirety.

F. Human Immunomodulators

Human immunomodulators suitable for use as adjuvants in the invention include cytokines, such as interleukins (e.g. IL-1, IL-2, IL-4, IL-5, IL-6, IL-7, IL-12 [73], etc.) [74], interferons (e.g. interferon-γ), macrophage colony stimulating factor, and tumor necrosis factor. A preferred immunomodulator is IL-12.

G. Bioadhesives and Mucoadhesives

Bioadhesives and mucoadhesives may also be used as adjuvants in the invention. Suitable bioadhesives include esterified hyaluronic acid microspheres [75] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention[76].

H. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of Ref. 11)

Examples of liposome formulations suitable for use as adjuvants are described in refs. 77-79.

J. Polyoxyethylene Ether and Polyoxyethylene Ester Formulations

Adjuvants suitable for use in the invention include polyoxyethylene ethers and polyoxyethylene esters [80]. Such formulations further include polyoxyethylene sorbitan ester surfactants in combination with an octoxynol [81] as well as polyoxyethylene alkyl ethers or ester surfactants in combination with at least one additional non-ionic surfactant such as an octoxynol [82]. Preferred polyoxyethylene ethers are selected from the following group: polyoxyethylene-9-lauryl ether (laureth 9), polyoxyethylene-9-steoryl ether, polyoxyethylene-8-steoryl ether, polyoxyethylene-4-lauryl ether, polyoxyethylene-35-lauryl ether, and polyoxyethylene-23-lauryl ether.

K. Polyphosphazene (PCPP)

PCPP formulations are described, for example, in refs. 83 and 84.

L. Muramyl Peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

M. Imidazoquinolone Compounds.

Examples of imidazoquinolone compounds suitable for use adjuvants in the invention include Imiquamod and its homologues (e.g. "Resiquimod 3M"), described further in refs. 85 and 86.

The invention may also comprise combinations of aspects of one or more of the adjuvants identified above. For example, the following adjuvant compositions may be used in the invention: (1) a saponin and an oil-in-water emulsion [87]; (2) a saponin (e.g. QS21)+a non-toxic LPS derivative (e.g. 3dMPL®) [88]; (3) a saponin (e.g. QS21)+a non-toxic LPS derivative (e.g. 3dMPL®)+a cholesterol; (4) a saponin (e.g. QS21)+3dMPL®+IL-12 (optionally+a sterol) [89]; (5) combinations of 3dMPL® with, for example, QS21 and/or oil-in-water emulsions [90]; (6) SAF, containing 10% squalene, 0.4% TWEEN® 80, 5% PLURONIC® block polymer L121, and thr-MDP, either microfluidized into a submicron emulsion or vortexed to generate a larger particle size emulsion. (7) Ribi adjuvant system (RAS), (Ribi Immunochem) containing 2% squalene, 0.2% TWEEN® 80, and one or more bacterial cell wall components from the group consisting of monophosphorylipid A (MPL®), trehalose dimycolate (TDM), and cell wall skeleton (CWS), preferably MPL®+CWS (DETOX™); and (8) one or more mineral salts (such as an aluminum salt)+a non-toxic derivative of LPS (such as 3dMPL®).

Other substances that act as immunostimulating agents are disclosed in chapter 7 of ref 11.

The use of an aluminium hydroxide and/or aluminium phosphate adjuvant is useful, particularly in children, and antigens are generally adsorbed to these salts. Squalene-in-water emulsions are also preferred, particularly in the elderly. Useful adjuvant combinations include combinations of Th1 and Th2 adjuvants such as CpG & alum or resiquimod & alum. A combination of aluminium phosphate and 3dMPL may be used.

The compositions of the invention may elicit both a cell mediated immune response as well as a humoral immune response.

Two types of T cells, CD4 and CD8 cells, are generally thought necessary to initiate and/or enhance cell mediated immunity and humoral immunity. CD8 T cells can express a CD8 co-receptor and are commonly referred to as Cytotoxic T lymphocytes (CTLs). CD8 T cells are able to recognized or interact with antigens displayed on MHC Class I molecules.

CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection.

An enhanced immune response may include one or more of an enhanced TH1 immune response and a TH2 immune response.

A TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. Preferably, the enhanced TH1 immune response will include an increase in IgG2a production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are preferred TH1 adjuvants for use in the invention.

A TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives thereof. Mineral containing compositions, such as aluminium salts are preferred TH2 adjuvants for use in the invention.

A composition may include a combination of a TH1 adjuvant and a TH2 adjuvant. Preferably, such a composition elicits an enhanced TH1 and an enhanced TH2 response, i.e., an increase in the production of both IgG1 and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e., relative to immunization with a TH1 adjuvant alone or immunization with a TH2 adjuvant alone).

The immune response may be one or both of a TH1 immune response and a TH2 response. Preferably, immune response provides for one or both of an enhanced TH1 response and an enhanced TH2 response.

The enhanced immune response may be one or both of a systemic and a mucosal immune response. Preferably, the immune response provides for one or both of an enhanced systemic and an enhanced mucosal immune response. Preferably the mucosal immune response is a TH2 immune response. Preferably, the mucosal immune response includes an increase in the production of IgA.

Streptococcal infections can affect various areas of the body and so the compositions of the invention may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition or a spray-freeze dried composition). The composition may be prepared for topical administration e.g. as an ointment, cream or powder. The composition may be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops. The composition may be in kit form, designed such that a combined composition is reconstituted just prior to administration to a patient. Such kits may comprise one or more antigens in liquid form and one or more lyophilised antigens.

Where a composition is to be prepared extemporaneously prior to use (e.g. where a component is presented in lyophilised form) and is presented as a kit, the kit may comprise two vials, or it may comprise one ready-filled syringe and one vial, with the contents of the syringe being used to reactivate the contents of the vial prior to injection.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials.

Nucleic Acid Immunisation

The immunogenic compositions described above include polypeptide antigens from GBS. In all cases, however, the polypeptide antigens can be replaced by nucleic acids (typically DNA) encoding those polypeptides, to give compositions, methods and uses based on nucleic acid immunisation [91 to 98].

The nucleic acid encoding the immunogen is expressed in vivo after delivery to a patient and the expressed immunogen then stimulates the immune system. The active ingredient will typically take the form of a nucleic acid vector comprising: (i) a promoter; (ii) a sequence encoding the immunogen, operably linked to the promoter; and optionally (iii) a selectable marker. Preferred vectors may further comprise (iv) an origin of replication; and (v) a transcription terminator downstream of and operably linked to (ii). In general, (i) & (v) will be eukaryotic and (iii) & (iv) will be prokaryotic.

Preferred promoters are viral promoters e.g. from cytomegalovirus (CMV). The vector may also include transcriptional regulatory sequences (e.g. enhancers) in addition to the promoter and which interact functionally with the promoter. Preferred vectors include the immediate-early CMV enhancer/promoter, and more preferred vectors also include CMV intron A. The promoter is operably linked to a downstream sequence encoding an immunogen, such that expression of the immunogen-encoding sequence is under the promoter's control.

Where a marker is used, it preferably functions in a microbial host (e.g. in a prokaryote, in a bacteria, in a yeast). The marker is preferably a prokaryotic selectable marker (e.g. transcribed under the control of a prokaryotic promoter). For convenience, typical markers are antibiotic resistance genes.

The vector is preferably an autonomously replicating episomal or extrachromosomal vector, such as a plasmid.

The vector preferably comprises an origin of replication. It is preferred that the origin of replication is active in prokaryotes but not in eukaryotes.

Preferred vectors thus include a prokaryotic marker for selection of the vector, a prokaryotic origin of replication, but a eukaryotic promoter for driving transcription of the immunogen-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors.

The vector may comprise a eukaryotic transcriptional terminator sequence downstream of the coding sequence. This can enhance transcription levels. Where the coding sequence does not have its own, the vector preferably comprises a polyadenylation sequence. A preferred polyadenylation sequence is from bovine growth hormone.

The vector may comprise a multiple cloning site

In addition to sequences encoding the immunogen and a marker, the vector may comprise a second eukaryotic coding sequence. The vector may also comprise an IRES upstream of said second sequence in order to permit translation of a second eukaryotic polypeptide from the same transcript as the immunogen. Alternatively, the immunogen-coding sequence may be downstream of an IRES.

The vector may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell.

Vectors may be delivered in a targeted way. Receptor-mediated DNA delivery techniques are described in, for example, references 99 to 104. Therapeutic compositions containing a nucleic acid are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect.

Vectors can be delivered using gene delivery vehicles. The gene delivery vehicle can be of viral or non-viral origin (see generally references 105 to 108).

Viral-based vectors for delivery of a desired nucleic acid and expression in a desired cell are well known in the art. Exemplary viral-based vehicles include, but are not limited to, recombinant retroviruses (e.g. references 109 to 119), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 120 to 125). Administration of DNA linked to killed adenovirus [126] can also be employed.

Non-viral delivery vehicles and methods can also be employed, including, but not limited to, polycationic condensed DNA linked or unlinked to killed adenovirus alone [e.g. 126], ligand-linked DNA [127], eukaryotic cell delivery vehicles cells [e.g. refs. 128 to 132] and nucleic charge neutralization or fusion with cell membranes. Naked DNA can also be employed. Exemplary naked DNA introduction methods are described in refs. 133 and 134. Liposomes (e.g. immunoliposomes) that can act as gene delivery vehicles are described in refs. 135 to 139. Additional approaches are described in references 140 & 141.

Further non-viral delivery suitable for use includes mechanical delivery systems such as the approach described in ref. 141. Moreover, the coding sequence and the product of expression of such can be delivered through deposition of photopolymerized hydrogel materials or use of ionizing radiation [e.g. refs. 142 & 143]. Other conventional methods for gene delivery that can be used for delivery of the coding sequence include, for example, use of hand-held gene transfer particle gun [144] or use of ionizing radiation for activating transferred genes [142 & 143].

Delivery of DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

Methods of Treatment, and Administration of the Vaccine

The invention also provides a method for raising an immune response in a mammal comprising the step of administering an effective amount of an immunogenic composition of the invention. The immune response is preferably protective and preferably involves antibodies and/or cell-mediated immunity. The method may raise a booster response.

The invention also provides at least two different GBS59 clades for combined use as a medicament e.g. for use in raising an immune response in a mammal.

The invention also provides the use of at least two different GBS59 clades in the manufacture of a medicament for raising an immune response in a mammal.

By raising an immune response in the mammal by these uses and methods, the mammal can be protected against disease and/or infection caused by GBS e.g. against meningitis.

The invention also provides a delivery device pre-filled with an immunogenic composition of the invention.

The mammal is preferably a human. The human may be a child (e.g. a toddler or infant), a teenager or an adult. A vaccine intended for children may also be administered to adults e.g. to assess safety, dosage, immunogenicity, etc.

One way of checking efficacy of therapeutic treatment involves monitoring pneumococcal infection after administration of the compositions of the invention. One way of checking efficacy of prophylactic treatment involves testing post-immunisation sera in standard tests; for example, sera can be tested in an opsonophagocytic killing assay (OPKA), with the ability to opsonise bacteria indicating protective efficacy. Another way of checking efficacy of prophylactic treatment involves post-immunisation challenge in an animal model of GBS infection, e.g., guinea pigs or mice. One such model is described in reference 145. Another way of assessing the immunogenicity of the compositions of the present invention is to express the polypeptides recombinantly for screening patient sera or mucosal secretions by immunoblot and/or microarrays. A positive reaction between the polypeptide and the patient sample indicates that the patient has mounted an immune response to the polypeptide in question. This method may also be used to identify immunodominant antigens and/or epitopes within antigens.

Compositions of the invention will generally be administered directly to a patient. Direct delivery may be accomplished by parenteral injection (e.g. subcutaneously, intraperitoneally, intravenously, intramuscularly, or to the interstitial space of a tissue), or mucosally, such as by rectal, oral (e.g. tablet, spray), vaginal, topical, transdermal or transcutaneous, intranasal, ocular, aural, pulmonary or other mucosal administration.

The invention may be used to elicit systemic and/or mucosal immunity, preferably to elicit an enhanced systemic and/or mucosal immunity.

Preferably the enhanced systemic and/or mucosal immunity is reflected in an enhanced TH1 and/or TH2 immune response. Preferably, the enhanced immune response includes an increase in the production of IgG1 and/or IgG2a and/or IgA.

Dosage can be by a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc. Multiple doses will typically be administered at least 1 week apart (e.g. about 2 weeks, about 3 weeks, about 4 weeks, about 6 weeks, about 8 weeks, about weeks, about 12 weeks, about 16 weeks, etc.).

Vaccines prepared according to the invention may be used to treat both children and adults. Thus a human patient may be less than 1 year old, less than 5 years old, 1-5 years old, 5-15 years old, 15-55 years old, or at least 55 years old. Preferred patients for receiving the vaccines are the elderly (e.g. ≥50 years old, ≥60 years old, and preferably ≥65 years), the young (e.g. ≤5 years old), hospitalised patients, healthcare workers, armed service and military personnel, pregnant women, the chronically ill, or immunodeficient patients. In general, the vaccines may be used to treat pregnant women and adolescents. The vaccines are not suitable solely for these groups, however, and may be used more generally in a population.

Vaccines produced by the invention may be administered to patients at substantially the same time as (e.g. during the same medical consultation or visit to a healthcare professional or vaccination centre) other vaccines e.g. at substantially at the same time as a rubella vaccine, a varicella vaccine, a diphtheria vaccine, a tetanus vaccine, a pertussis vaccine, a DTP vaccine, an inactivated poliovirus vaccine, a hepatitis B virus vaccine, a meningococcal conjugate vaccine (such as a tetravalent A-C—W135-Y vaccine), a respiratory syncytial virus vaccine, an human papillomavirus vaccine, an influenza virus vaccines (including a pandemic influenza virus vaccine) etc.

Vaccines of the invention may also be administered to patients at substantially the same time as (e.g. during the same medical consultation or visit to a healthcare professional) an antiviral compound, and in particular an antiviral compound active against influenza virus (e.g. oseltamivir and/or zanamivir). These antivirals include neuraminidase inhibitors, such as a (3R,4R,5S)-4-acetylamino-5-amino-3(1-ethylpropoxy)-1-cyclohexene-1-carboxylic acid or 5-(acetylamino)-4-[(aminoiminomethyl)-amino]-2,6-anhydro-3,4,5-trideoxy-D-glycero-D-galactonon-2-enonic acid, including esters thereof (e.g. the ethyl esters) and salts thereof (e.g. the phosphate salts). A preferred antiviral is (3R,4R,5S)-4-acetylamino-5-amino-3(1-ethylpropoxy)-1-cyclohexene-1-carboxylic acid, ethyl ester, phosphate (1:1), also known as oseltamivir phosphate (TAMIFLU®).

Combinations

A composition useful for immunisation comprises at least two GBS59 clades, either as a hybrid polypeptide or as separate polypeptides. In addition, a composition may include:

(i) one or more further polypeptides that elicit antibody responses against GBS proteins, particularly against GBS proteins other than GBS59; (ii) a capsular saccharide from GBS; and/or (iii) one or more further immunogens that elicit antibody responses that recognise epitopes on non-GBS organisms.

Combinations with Further Polypeptide Antigens [146]

GBS polypeptides from two or more clades may be combined with one or more (i.e. 1, 2, 3, 4, 5, 6, 7, 8, 9, or all 10) polypeptide antigens selected from the group consisting of: (1) a (GBS80) antigen; (2) a GBS67 antigen; (3) a GBS1523 antigen; (4) a GBS 104 antigen; (5) a GBS1524 antigen; (6) a GBS3 antigen; (7) a SAN1483 antigen; (8) a GBS147 antigen; (9) a GBS328 antigen; and/or (10) a GBS84 antigen.

These further antigens may be added as separate polypeptides. As an alternative, they may be added as hybrids e.g. a GBS80-GBS1523 hybrid. As a further alternative, they may be fused to a GBS59 polypeptide sequence to provide a hybrid polypeptide e.g. a GBS59-GBS80 hybrid.

Any of these combinations may also include one or more GBS capsular saccharide(s), which will typically be conjugated to carrier protein(s). Further information about such saccharides and conjugation is provided below.

GBS80

The original 'GBS80' (SAG0645) sequence was annotated in reference 147 as a cell wall surface anchor family protein (see GI: 22533660). For reference purposes, the amino acid sequence of full length GBS80 as found in the 2603 strain is given as SEQ ID NO: 177 herein. Preferred GBS80 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO:177; and/or (b) comprising a fragment of at least 'n' consecutive amino acids of SEQ ID NO: 177, wherein 'n' is 7 or more (e.g. 8, 10, 12, 14, 16, 18, 20, 25, 30, 35, 40, 50, 60, 70, 80, 90, 100, 150, 200, 250 or more). These GBS80 proteins include variants of SEQ ID NO: 177.

Preferred fragments of (b) comprise an epitope from SEQ ID NO: 177. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 177 while retaining at least one epitope of SEQ ID NO: 177. Other fragments omit one or more protein domains.

Wild-type GBS80 contains a N-terminal leader or signal sequence region at amino acids 1-37 of SEQ ID NO:177. One or more amino acids from the leader or signal sequence region of GBS80 can be removed, e.g. SEQ ID NO:178. The wild-type sequence also contains a C-terminal transmembrane region at amino acids 526-543 of SEQ ID NO: 177. One or more amino acids from the transmembrane region and/or a cytoplasmic region may be removed, e.g. SEQ ID NO:179. Wild-type GBS80 contains an amino acid motif indicative of a cell wall anchor at amino acids 521-525 of SEQ ID NO:177. In some recombinant host cell systems it may be useful to remove this motif to facilitate secretion of a recombinant GBS80 polypeptide from the host cell. Thus the transmembrane and/or cytoplasmic regions and the cell wall anchor motif may be removed from GBS80, e.g. SEQ ID NO:180. Alternatively, in some recombinant host cell systems it may be useful to use the cell wall anchor motif to anchor the recombinantly expressed polypeptide to the cell wall. The extracellular domain of the expressed polypeptide may be cleaved during purification or the recombinant polypeptide may be left attached to either inactivated host cells or cell membranes in the final composition, e.g. SEQ ID NO:181. A particularly immunogenic fragment of wild-type GBS80 is located towards the N-terminus of the polypeptide, and is SEQ ID NO:182.

GBS67

The original 'GBS67' (SAG1408) sequence was annotated in reference 147 as a cell wall surface anchor family protein (see GI: 22534437). For reference purposes, the amino acid sequence of full length GBS67 as found in the 2603 strain is given as SEQ ID NO: 183 herein. Preferred GBS67 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 183; and/or (b) comprising a fragment of at least 'n' consecutive amino acids of SEQ ID NO: 183, wherein 'n' is 7 or more (e.g. 8, 10, 12, 14, 16, 18, 20, 25, 30, 35, 40, 50, 60, 70, 80, 90, 100, 150, 200, 250 or more). These GBS67 proteins include variants of SEQ ID NO: 183. Preferred fragments of (b) comprise an epitope from SEQ ID NO: 183. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 183 while retaining at least one epitope of SEQ ID NO: 183. Other fragments omit one or more protein domains.

Wild-type GBS67 contains a C-terminus transmembrane region which may be removed e.g. to give SEQ ID NO: 184. It also contains amino acid motifs indicative of a cell wall anchor (LPXTG, SEQ ID NO:272; and IPMTG, SEQ ID NO:273). In some recombinant host cell systems, it may be preferable to remove this motif to facilitate secretion from the host cell. Accordingly, in one preferred fragment of GBS67 for use in the invention, the transmembrane and the cell wall anchor motif are removed (SEQ ID NO:185). Alternatively, in some recombinant host cell systems, it may be preferable to use the cell wall anchor motif to anchor the recombinantly expressed polypeptide to the cell wall. The extracellular domain of the expressed polypeptide may be cleaved during purification or the recombinant polypeptide may be left attached to either inactivated host cells or cell membranes in the final composition.

Three pilin motifs, containing conserved lysine residues have been identified in GBS67. Conserved lysine residues are at amino acid residues 478 and 488, at amino acid residues 340 and 342, and at amino acid residues 703 and 717. The pilin sequences, in particular the conserved lysine residues, are thought to be important for the formation of oligomeric, pilus-like structures of GBS67. Preferred fragments of GBS67 include at least one conserved lysine residue. Two E boxes containing conserved glutamic residues have also been identified in GBS67. Preferred fragments of GBS 67 include at least one conserved glutamic acid residue. GBS67 contains several regions predicted to form alpha helical structures. Such alpha helical regions are likely to form coiled-coil structures and may be involved in oligomerization of GBS67. GBS67 also contains a region which is homologous to the Cna_B domain of the *S. aureus* collagen-binding surface protein (pfam05738). This may form a beta sandwich structure. GBS67 contains a region which is homologous to a von Willebrand factor (vWF) type A domain which may also be retained in the fragments of GBS67.

Particularly immunogenic fragments of wild-type GBS67 from the 2603 strain are located towards the N-terminus of the polypeptide, and are SEQ ID NO:186 and SEQ ID NO:187.

A variant of GBS67 (SAI1512) exists in strain H36B. This variant 'GBS67' (SAG1408) sequence was annotated in reference 148 as a cell wall surface anchor family protein (see GI: 77405751). For reference purposes, the amino acid sequence of full length GBS67 as found in the H36B strain is given as SEQ ID NO: 188 herein. Preferred GBS67 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 188; and/or (b) comprising a fragment of at least 'n' consecutive amino acids of SEQ ID NO: 188, wherein 'n' is 7 or more (e.g. 8, 10, 12, 14, 16, 18, 20, 25, 30, 35, 40, 50, 60, 70, 80, 90, 100, 150, 200, 250 or more). Preferred fragments of (b) comprise an epitope from SEQ ID NO: 188. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 188 while retaining at least one epitope of SEQ ID NO: 188. Other fragments omit one or more protein domains.

The invention includes the use of fragments of GBS67 from the H36B strain that are analogous to fragments of GBS67 from the 2603 strain discussed in detail above, e.g. lacking the C-terminus transmembrane region, lacking the transmembrane region and/or cell wall anchor motif (LPXTG, SEQ ID NO:272; and IPMTG, SEQ ID NO:273), containing conserved pilin motifs or lysine residues within the pilin motifs, containing conserved glutamic acid residues, alpha helical regions, the Cna_B domain and/or the (vWF) type A domain. Particularly immunogenic fragments of wild-type GBS67 from the H36B strain are located towards the N-terminus of the polypeptide, and are SEQ ID NO:189 and SEQ ID NO:190.

Variants of GBS67 also exist in strains CJB111, 515, NEM316, DK21 and CJB110. For reference purposes, the amino acid sequences of full length GBS67 as found in the CJB111, 515, NEM316, DK21 and CJB110 strains are given as SEQ ID NOS: 191, 194, 197, 200 and 203 herein. Preferred GBS67 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NOS: 191, 192, 193, 194 or 195; and/or (b) comprising a fragment of at least 'n' consecutive amino acids of SEQ ID NOS: 191, 194, 197, 200 and 203, wherein 'n' is 7 or more (e.g. 8, 10, 12, 14, 16, 18, 20, 25, 30, 35, 40, 50, 60, 70, 80, 90, 100, 150, 200, 250 or more). Preferred fragments of (b) comprise an epitope from SEQ ID NOS: 191, 194, 197, 200 or 203. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NOS: 191, 194, 197, 200 or 203 while retaining at least one epitope of SEQ ID NOS: 191, 194, 197, 200 or 203. Other fragments omit one or more protein domains.

The invention includes the use of fragments of GBS67 from the CJB111, 515, NEM316, DK21 and CJB110 strains that are analogous to fragments of GBS67 from the 2603 strain discussed in detail above, e.g. lacking the C-terminus transmembrane region, lacking the transmembrane region and/or cell wall anchor motif (LPXTG, SEQ ID NO:272; and IPMTG, SEQ ID NO:273), containing conserved pilin motifs or lysine residues within the pilin motifs, containing conserved glutamic acid residues, alpha helical regions, the Cna_B domain and/or the (vWF) type A domain. Particularly immunogenic fragments of wild-type GBS67 from the CJB111, 515, NEM316, DK21 and CJB110 are located towards the N-terminus of the polypeptide, and are SEQ ID NO:192 and SEQ ID NO:193 (CJB111), SEQ ID NO:195 and SEQ ID NO:196 (515), SEQ ID NO:198 and SEQ ID NO:199 (NEM316), SEQ ID NO:201 and SEQ ID NO:202 (DK21), and SEQ ID NO:204 and SEQ ID NO:205 (CJB110).

GBS1523

The original 'GBS 1523' (SAN1518; SpbI) sequence was annotated in reference 148 as a cell wall surface anchor family protein (see GI: 77408651). For reference purposes, the amino acid sequence of full length GBS1523 as found in the COH1 strain is given as SEQ ID NO: 206 herein. Preferred GBS1523 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 206; and/or (b) comprising a fragment of at least 'n' consecutive amino acids of SEQ ID NO: 206, wherein 'n' is 7 or more (e.g. 8, 10, 12, 14, 16, 18, 20, 25, 30, 35, 40, 50, 60, 70, 80, 90, 100, 150, 200, 250 or more). These GBS1523 proteins include variants of SEQ ID NO: 206. Preferred fragments of (b) comprise an epitope from SEQ ID NO: 206. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 206 while retaining at least one epitope of SEQ ID NO: 206. Other fragments omit one or more protein domains.

Wild-type GBS1523 contains a N-terminal leader or signal sequence region at amino acids 1 to 29 of SEQ ID NO:206 which may be removed in fragments, e.g. SEQ ID NO:207. The wild-type sequence contains an amino acid motif indicative of a cell wall anchor (LPSTG) at amino acids 468-472 of SEQ ID NO:206. In some recombinant host cell systems, it may be preferable to remove this motif to facilitate secretion of a recombinant polypeptide from the cell. Alternatively, it may be preferable to use the cell wall anchor motif to anchor the recombinantly expressed polypeptide to the cell wall. The extracellular domain of the expressed polypeptide may be cleaved during purification or the recombinant polypeptide may be left attached to either inactivated host cells or cell membranes in the final composition. An E box containing a conserved glutamic residue has also been identified at amino acids 419-429 of SEQ ID NO:206, with a conserved glutamic acid at residue 423. The E box motif may be important for the formation of oligomeric pilus-like structures, and so useful fragments of GBS1523 may include the conserved glutamic acid residue. A mutant of GBS1523 has been identified in which the glutamine (Q) at position 41 of SEQ ID NO:206 is substituted for a lysine (K), as a result of a mutation of a codon in the encoding nucleotide sequence from CAA to AAA. This substitution may be present in the GBS1523 sequences and GBS1523 fragments (e.g. SEQ ID NO:208).

Where the compositions include both GBS80 and GBS1523, a hybrid polypeptide may be used. Examples of GBS80-GBS1523 hybrids are found in reference 149 and include the polypeptides of SEQ ID NOS: 209-212.

GBS 104

The original 'GBS104' (SAG0649) sequence was annotated in reference 147 as 'a cell wall surface anchor family protein' (see GI: 22533664). For reference purposes, the amino acid sequence of full length GBS104 as found in the 2603 strain is given as SEQ ID NO: 213 herein. Preferred GBS104 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 213; and/or (b) comprising a fragment of at least 'n' consecutive amino acids of SEQ ID NO: 213, wherein 'n' is 7 or more (e.g. 8, 10, 12, 14, 16, 18, 20, 25, 30, 35, 40, 50, 60, 70, 80, 90, 100, 150, 200, 250 or more). These GBS104 proteins include variants of SEQ ID NO: 213. Preferred fragments of (b) comprise an epitope from SEQ ID NO: 213. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 213 while retaining at least one epitope of SEQ ID NO: 213. Other fragments omit one or more protein domains.

GBS 1524

For reference purposes, the amino acid sequence of full length GBS1524 is given as SEQ ID NO: 214 herein. Preferred GBS1524 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 214; and/or (b) comprising a fragment of at least 'n' consecutive amino acids of SEQ ID NO: 214, wherein 'n' is 7 or more (e.g. 8, 10, 12, 14, 16, 18, 20, 25, 30, 35, 40, 50, 60, 70, 80, 90, 100, 150, 200, 250 or more). These GBS1524 proteins include variants of SEQ ID NO: 214. Preferred fragments of (b) comprise an epitope from SEQ ID NO: 214. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 214 while retaining at least one epitope of SEQ ID NO: 214. Other fragments omit one or more protein domains.

GBS3

The original 'GBS3' (SAG2603; BibA) sequence was annotated in reference 147 as 'a pathogenicity protein' (see GI: 22535109). For reference purposes, the amino acid sequence of full length GBS3 as found in the 2603 strain is given as SEQ ID NO: 215 herein. Preferred GBS3 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 215; and/or (b) comprising a fragment of at least 'n' consecutive amino acids of SEQ ID NO: 215, wherein 'n' is 7 or more (e.g. 8, 10, 12, 14, 16, 18, 20, 25, 30, 35, 40, 50, 60, 70, 80, 90, 100, 150, 200, 250 or more). These GBS3 proteins include variants of SEQ ID NO: 215. Preferred fragments of (b) comprise an epitope from SEQ ID NO: 215.

Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 215 while retaining at least one epitope of SEQ ID NO: 215. Other fragments omit one or more protein domains.

Wild-type GBS3 contains a N-terminal leader or signal sequence region at amino acids 1 to 36 of SEQ ID NO:215 which may be removed in fragments, e.g. SEQ ID NO:216.GBS3 also contains an amino acid motif indicative of a cell wall anchor (LPXTG, SEQ ID NO:272), a transmembrane region and cytoplasmic domains (see reference 150). The leader or signal sequence region, the transmembrane and cytoplasmic domains, and the cell wall anchor motif may all be removed from GBS3 to leave a fragment comprising the coiled-coil and proline-rich segments as set forth below (SEQ ID NO:217). Alternative fragments of GBS3 may comprise: the signal sequence region and coiled coil segment (SEQ ID NO:218); the coiled coil segment (SEQ NO:219); or the signal sequence region, coiled coil segment, and proline-rich segment (SEQ ID NO:220).

Variants of GBS3 exist in the 515 strain (SAL2118), CJB111 strain (SAM1974) and COH1 strain (SAN2207). Reference amino acid sequences for full-length GBS3 in the 515 strain, the CJB111 strain and the COH1 strain are given herein as SEQ ID NO: 221, SEQ ID NO:222 and SEQ ID NO:223 respectively. Thus, GBS3 polypeptides for use with the invention may also comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 221, SEQ ID NO:222 or SEQ ID NO:223; and/or (b) comprising a fragment of at least 'n' consecutive amino acids of SEQ ID NO: 221, SEQ ID NO:222 or SEQ ID NO:223, wherein 'n' is 7 or more (e.g. 8, 10, 12, 14, 16, 18, 20, 25, 30, 35, 40, 50, 60, 70, 80, 90, 100, 150, 200, 250 or more). These GBS3 proteins include variants of SEQ NO: 221, SEQ ID NO:222 or SEQ NO:223. Preferred fragments of (b) comprise an epitope from SEQ ID NO: 221, SEQ ID NO:222 or SEQ ID NO:223. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 221, SEQ ID NO:222 or SEQ ID NO:223 while retaining at least one epitope of SEQ ID NO: 221, SEQ ID NO:222 or SEQ ID NO:223. Other fragments omit one or more protein domains.

The invention includes the use of fragments of GBS3 from the 515, cjb111 and coh1 strains that are analogous to fragments of GBS3 from the 2603 strain discussed in detail above, e.g. lacking the N-terminal leader or signal sequence region; comprising the coiled-coil and proline-rich segments; comprising the signal sequence region and coiled coil segment; comprising the coiled coil segment; or comprising the signal sequence region, coiled coil segment, and proline-rich segment

SAN1485

The original 'SAN1485' sequence was annotated in reference 148 as 'cell wall surface anchor family protein' (see GI: 77408233). For reference purposes, the amino acid sequence of full length SAN1485 as found in the COH1 strain is given as SEQ ID NO: 224 herein. Preferred SAN1485 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 224; and/or (b) comprising a fragment of at least 'n' consecutive amino acids of SEQ ID NO: 224, wherein 'n' is 7 or more (e.g. 8, 10, 12, 14, 16, 18, 20, 25, 30, 35, 40, 50, 60, 70, 80, 90, 100, 150, 200, 250 or more). These SAN1485 proteins include variants of SEQ ID NO: 224. Preferred fragments of (b) comprise an epitope from SEQ ID NO: 224. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 224 while retaining at least one epitope of SEQ ID NO: 224. Other fragments omit one or more protein domains.

GBS147

The original 'GBS147' (SAG0416) sequence was annotated in reference 147 as 'a putative protease' (see GI: 22533435). For reference purposes, the amino acid sequence of full length GBS147 as found in the 2603 strain is given as SEQ ID NO: 225 herein. Preferred GBS147 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 225 and/or (b) comprising a fragment of at least 'n' consecutive amino acids of SEQ ID NO: 225, wherein 'n' is 7 or more (e.g. 8, 10, 12, 14, 16, 18, 20, 25, 30, 35, 40, 50, 60, 70, 80, 90, 100, 150, 200, 250 or more). These GBS147 proteins include variants of SEQ ID NO: 225. Preferred fragments of (b) comprise an epitope from SEQ ID NO: 225. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 225 while retaining at least one epitope of SEQ ID NO: 225.

GBS328

The original 'GBS328' (SAG1333) sequence was annotated in reference 147 as '5'-nucleotidase family protein' (see GI: 22534359). For reference purposes, the amino acid sequence of full length GBS328 as found in the 2603 strain is given as SEQ ID NO:226 herein. Preferred GBS328 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 226; and/or (b) comprising a fragment of at least 'n' consecutive amino acids of SEQ ID NO: 226, wherein 'n' is 7 or more (e.g. 8, 10, 12, 14, 16, 18, 20, 25, 30, 35, 40, 50, 60, 70, 80, 90, 100, 150, 200, 250 or more). These GBS328 proteins include variants of SEQ ID NO: 226. Preferred fragments of (b) comprise an epitope from SEQ ID NO: 226. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 226 while retaining at least one epitope of SEQ ID NO: 226. Other fragments omit one or more protein domains.

GBS84

The original 'GBS84' (SAG0907) sequence was annotated in reference 147 as 'a putative lipoprotein' (see GI: 22533929). For reference purposes, the amino acid sequence of full length GBS84 as found in the 2603 strain is given as SEQ ID NO: 227 herein. Preferred GBS84 polypeptides for use with the invention comprise an amino acid sequence: (a) having 60% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 227; and/or (b) comprising a fragment of at least 'n' consecutive amino acids of SEQ ID NO: 227, wherein 'n' is 7 or more (e.g. 8, 10, 12, 14, 16, 18, 20, 25, 30, 35, 40, 50, 60, 70, 80, 90, 100, 150, 200, 250 or more). These GBS84 proteins include variants of SEQ ID NO: 227. Preferred fragments of (b) comprise an epitope from SEQ ID NO: 227. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 227 while retaining at least one epitope of SEQ ID NO: 227. Other fragments omit one or more protein domains.

Combinations with GBS Saccharides

GBS59 polypeptides may be combined with one or more GBS capsular saccharide(s), which will typically be conjugated to carrier protein(s). Thus the invention provides an immunogenic composition comprising a combination of:

(1) a GBS59 polypeptide as discussed above; and
(2) one or more GBS capsular saccharides.

A saccharide used in component (2) of this combination is ideally present as a conjugate comprising a saccharide moiety and a carrier protein moiety. The carrier moiety in the conjugate may be a single GBS59 polypeptide, a hybrid GBS59 polypeptide, a non-GBS59 GBS polypeptide, or a non-GBS polypeptide.

The saccharide is from the capsular saccharide of GBS. The saccharide may be a polysaccharide having the size that arises during purification of the saccharide from bacteria, or it may be an oligosaccharide achieved by fragmentation of such a polysaccharide.

A composition may include a capsular saccharide from one or more of the following streptococcal serotypes: Ia, Ib, Ia/c, II, III, IV, V, VI, VII and VIII. A composition may include multiple serotypes e.g. 2, 3, 4, 5, 6, 7, or 8 serotypes. Including a saccharide from one or more of serotypes Ia, Ib, II, III & V is useful. The capsular saccharides of each of these five serotypes include: (a) a terminal N-acetyl-neuraminic acid (NeuNAc) residue (commonly referred to as sialic acid), which in all cases is linked 2→3 to a galactose residue; and (b) a N-acetyl-glucosamine residue (GlcNAc) within the trisaccharide core.

Saccharides used according to the invention may be in their native form, or may have been modified. For example, the saccharide may be shorter than the native capsular saccharide, or may be chemically modified. For instance, the saccharide may be de-O-acetylated (partially or fully), de-N-acetylated (partially or fully) or N-propionated (partially or fully), etc. De-acetylation may occur before, during or after conjugation, but preferably occurs before conjugation. Depending on the particular saccharide, de-acetylation may or may not affect immunogenicity. The relevance of O-acetylation on GBS saccharides in various serotypes is discussed in ref. 151, and in some embodiments O-acetylation of sialic acid residues at positions 7, 8 and/or 9 is retained before, during and after conjugation e.g. by protection/de-protection, by re-acetylation, etc. However, typically the GBS saccharide used in the present invention has substantially no O-acetylation of sialic acid residues at positions 7, 8 and/or 9. The effect of de-acetylation etc. can be assessed by routine assays. Another possible modification is the removal of sialic acid residues from the saccharide, such as side-chain terminal sialic acids [152]. In particular, when a serotype V capsular saccharide is used in the invention, it may be modified by desialylation as described in ref. [152]. Desialylated GBS serotype V capsular saccharide may be prepared by treating purified GBS serotype V capsular saccharide under mildly acidic conditions (e.g. 0.1M sulphuric acid at 80° C. for 60 minutes) or by treatment with neuraminidase, as described in ref [152]. In another example, full-length polysaccharides may be depolymerised to give shorter fragments for use with the invention e.g. by hydrolysis in mild acid, by heating, by sizing chromatography, etc. Chain length has been reported to affect immunogenicity of GBS saccharides in rabbits [153]. In particular, when a serotype II and/or III capsular saccharide is used in the invention, it may be depolymerised as described in ref 154. This document describes the partial depolymerization of type II and type III capsular saccharides by mild deaminative cleavage to antigenic fragments with reducing-terminal 2,5-anhydro-D-mannose residues.

Capsular saccharides can be purified by known techniques, as described in the references herein such as ref 155. A typical process involves base extraction, centrifugation, filtration, RNase/DNase treatment, protease treatment, concentration, size exclusion chromatography, ultrafiltration, anion exchange chromatography, and further ultrafiltration. As an alternative, the purification process described in ref. 156 can be used. This process involves base extraction, ethanol/$CaCl_2$ treatment, CTAB precipitation, and re-solubilisation.

The invention is not limited to saccharides purified from natural sources, however, and the saccharides may be obtained by other methods, such as total or partial synthesis. Saccharides will typically be conjugated to a carrier protein. In general, covalent conjugation of saccharides to carriers enhances the immunogenicity of saccharides as it converts them from T-independent antigens to T-dependent antigens, thus allowing priming for immunological memory.

Conjugation of GBS saccharides has been widely reported e.g. see refs. 157 to 164. The typical prior art process for GBS saccharide conjugation involves reductive amination of a purified saccharide to a carrier protein such as tetanus toxoid (TT) or CRM197 [158]. The reductive amination involves an amine group on the side chain of an amino acid in the carrier and an aldehyde group in the saccharide. As GBS capsular saccharides do not include an aldehyde group in their natural form then this is typically generated before conjugation by oxidation (e.g. periodate oxidation) of a portion of the saccharide's sialic acid residues [158, 165]. Conjugate vaccines prepared in this manner have been shown to be safe and immunogenic in humans for each of GBS serotypes Ia, Ib, II, III, and V [166].

Preferred carrier proteins are bacterial toxins, such as diphtheria or tetanus toxins, or toxoids or mutants thereof. These are commonly used in conjugate vaccines. A carrier protein in a conjugate may or may not be one of the GBS59 antigens of (1). If it is not a GBS59 antigen it may instead be a different GBS antigen. In some embodiments, though, the carrier is not a GBS antigen, and may be e.g. a bacterial toxin or toxoid.

Typical carrier proteins are diphtheria or tetanus toxoids or mutants thereof. Fragments of toxins or toxoids can also be used e.g. fragment C of tetanus toxoid [167]. The CRM197 mutant of diphtheria toxin[168-170] is a particularly useful with the invention. Other suitable carrier proteins include *N. meningitidis* outer membrane protein complex [171], synthetic peptides [172, 173], heat shock proteins [174, 175], pertussis proteins [176, 177], cytokines [178], lymphokines [188], hormones [188], growth factors, artificial proteins comprising multiple human $CD4^+$ T cell epitopes from various pathogen-derived antigens [179] such as N19 [180], protein D from *H. influenzae* [181-183], iron-uptake proteins [184], toxin A or B from *C. difficile* [185], recombinant *P. aeruginosa* exoprotein A (rEPA) [186], etc.

Where a composition includes more than one conjugate, each conjugate may use the same carrier protein or a different carrier protein.

In some embodiments, a single conjugate may carry saccharides from multiple serotypes [187]. Usually, however, each conjugate will include saccharide from a single serotype.

Conjugates may have excess carrier (w/w) or excess saccharide (w/w). In some embodiments, a conjugate may include equal weights of each. For example, conjugates with a saccharide:protein ratio (w/w) of between 1:5 and 5:1 may be used, in particular ratios between 1:5 and 2:1.

The carrier molecule may be covalently conjugated to the carrier directly or via a linker. Direct linkages to the protein may be achieved by, for instance, reductive amination between the saccharide and the carrier, as described in, for example, references 188 and 189. The saccharide may first need to be activated e.g. by oxidation. Linkages via a linker group may be made using any known procedure, for example, the procedures described in references 190 and 191. A preferred type of linkage is an adipic acid linker, which may be formed by coupling a free —NH$_2$ group (e.g. introduced to a glucan by amination) with adipic acid (using, for example, diimide activation), and then coupling a protein to the resulting saccharide-adipic acid intermediate [192, 193]. Another preferred type of linkage is a carbonyl linker, which may be formed by reaction of a free hydroxyl group of a saccharide CDI [194, 195] followed by reaction with a protein to form a carbamate linkage. Other linkers include β-propionamido [196], nitrophenyl-ethylamine [197], haloacyl halides [198], glycosidic linkages [199], 6-aminocaproic acid [200], ADH [201], C$_4$ to C$_{12}$ moieties [202], etc. Carbodiimide condensation can also be used [203].

Combinations with Non-GBS Antigens

The GBS59 Glade combinations may be used in combination with non-GBS antigens. Thus the invention provides an immunogenic composition comprising a combination of:

(1) a combination of at least two GBS59 clades as discussed above, as a mixture or hybrid; and (2) one or more antigen(s) selected from the group consisting of: diphtheria toxoid; tetanus toxoid; one or more pertussis antigens; hepatitis B virus surface antigen; an inactivated poliovirus antigen; a conjugate of the capsular saccharide antigen from serogroup C of *Neisseria meningitidis*; a conjugate of the capsular saccharide antigen from serogroup Y of *Neisseria meningitidis*; a conjugate of the capsular saccharide antigen from serogroup W135 of *Neisseria meningitidis*; a conjugate of the capsular saccharide antigen from serogroup A of *Neisseria meningitides*; one or more influenza antigens; and one or more human papillomavirus antigens.

Diphtheria toxoid can be obtained by treating (e.g. using formaldehyde) diphtheria toxin from *Corynebacterium diphtheriae*. Diphtheria toxoids are disclosed in more detail in, for example, chapter 13 of reference 204.

Tetanus toxoid can be obtained by treating (e.g. using formaldehyde) tetanus toxin from *Clostridium tetani*. Tetanus toxoids are disclosed in more detail in chapter 27 of reference 204.

Pertussis antigens in vaccines are either cellular (whole cell, Pw) or acellular (Pa). The invention can use either sort of pertussis antigen. Preparation of cellular pertussis antigens is well documented (e.g. see chapter 21 of reference 204) e.g. it may be obtained by heat inactivation of phase I culture of *B. pertussis*. Acellular pertussis antigen(s) comprise specific purified *B. pertussis* antigens, either purified from the native bacterium or purified after expression in a recombinant host. It is usual to use more than one acellular antigen, and so a composition may include one, two or three of the following well-known and well-characterized *B. pertussis* antigens: (1) detoxified pertussis toxin (pertussis toxoid, or 'PT'); (2) filamentous hemagglutinin ('FHA'); (3) pertactin (also known as the '69 kiloDalton outer membrane protein'). FHA and pertactin may be treated with formaldehyde prior to use according to the invention. PT may be detoxified by treatment with formaldehyde and/or glutaraldehyde but, as an alternative to this chemical detoxification procedure, it may be a mutant PT in which enzymatic activity has been reduced by mutagenesis [205]. Further acellular pertussis antigens that can be used include fimbriae (e.g. agglutinogens 2 and 3).

Hepatitis B virus surface antigen (HBsAg) is the major component of the capsid of hepatitis B virus. It is conveniently produced by recombinant expression in a yeast, such as a *Saccharomyces cerevisiae*.

Inactivated poliovirus (IPV) antigens are prepared from viruses grown on cell culture and then inactivated (e.g. using formaldehyde). Because poliomyelitis can be caused by one of three types of poliovirus, as explained in chapter 24 of reference 204, a composition may include three poliovirus antigens: poliovirus Type 1 (e.g. Mahoney strain), poliovirus Type 2 (e.g. MEF-1 strain), and poliovirus Type 3 (e.g. Saukett strain).

When a composition includes one of diphtheria toxoid, tetanus toxoid or an acellular pertussis antigen in component (2) then it will usually include all three of them i.e. component (2) will include a D-T-Pa combination.

When a composition includes one of diphtheria toxoid, tetanus toxoid or a cellular pertussis antigen in component (2) then it will usually include all three of them i.e. component (2) will include a D-T-Pw combination.

Human papillomavirus antigens include L1 capsid proteins, which can assemble to form structures known as virus-like particles (VLPs). The VLPs can be produced by recombinant expression of L1 in yeast cells (e.g. in *S. cerevisiae*) or in insect cells (e.g. in *Spodoptera* cells, such as *S. frugiperda*, or in *Drosophila* cells). For yeast cells, plasmid vectors can carry the L1 gene(s); for insect cells, baculovirus vectors can carry the L1 gene(s). More preferably, the composition includes L1 VLPs from both HPV-16 and HPV-18 strains. This bivalent combination has been shown to be highly effective [206]. In addition to HPV-16 and HPV-18 strains, it is also possible to include L1 VLPs from HPV-6 and HPV-11 strains to give a tetravalent combination.

Influenza antigens may be in the form of currently an influenza virus vaccine. Various forms of influenza virus vaccine are currently available (e.g. see chapters 17 & 18 of reference [204]). Vaccines are generally based either on live virus, inactivated virus, recombinant hemagglutinin or virosomes. Inactivated vaccines may be based on whole virions, split virions, or on purified surface antigens. The antigen in vaccines of the invention may take the form of a live virus or, more preferably, an inactivated virus. The vaccine can be, for instance, a trivalent vaccine (e.g. including hemagglutinin from a A/H1N1 strain, a A/H3N2 strain and a B strain). In other embodiments the vaccine is a monovalent vaccine (e.g. including hemagglutinin from a A/H1N1 strain or a A/H5N1 strain). The vaccine can be adjuvanted (e.g. with an oil-in-water emulsion) or unadjuvanted.

Antibodies

Antibodies against GBS antigens can be used for passive immunisation [207]. Thus the invention provides a combination of antibodies for simultaneous, separate or sequential administration, wherein the combination includes at least two of: (a) an antibody which recognises a first amino acid sequence as defined above; (b) an antibody which recognises a second amino acid sequence as defined above; and/or (c) an antibody which recognises a third amino acid sequence as defined above.

The invention also provides the use of such antibody combinations in therapy. The invention also provides the use of such antibody combinations in the manufacture of a medicament. The invention also provides a method for treating a mammal comprising the step of administering to the mammal an effective amount of such a combination. As described above for immunogenic compositions, these methods and uses allow a mammal to be protected against GBS infection.

Monoclonal antibodies that can be used in conjunction with the invention include 17C4/A3 and 4H11/B7, which bind the surface-exposed fragment of D3 (515 Glade) at amino acids 411-436 (SEQ ID NO: 270). The heavy chain of 4H11/B7 comprises the amino acids provided in SEQ ID NO: 263 and is encoded by a nucleic acid molecule comprising SEQ ID NO: 262. The light chain of 4H11/B7 comprises the amino acids provided in SEQ ID NO: 265 and is encoded by a nucleic acid molecule comprising SEQ ID NO: 264. The heavy chain of 17C4/A3 comprises the amino acids provided in SEQ ID NO: 267 and is encoded by a nucleic acid molecule comprising SEQ ID NO: 266. The light chain of 17C4/A3 comprises the amino acids provided in SEQ ID NO: 269 and is encoded by a nucleic acid molecule comprising SEQ ID NO: 268.

The present invention provides antibodies with significant sequence identity to 17C4/A3 and 4H11/B7 and nucleic acid molecules encoding such antibodies. For example, the present invention includes antibodies having a heavy chain with greater than 60, 70, 80, 90, 95, 96, 97, 98 or 99% sequence identity to the heavy chain of 4H11/B7 (SEQ ID NO: 263) and/or having a light chain with greater than 60, 70, 80, 90, 95, 96, 97, 98 or 99% sequence identity to the light chain of 4H11/B7 (SEQ ID NO: 265). The present invention also includes antibodies having a heavy chain with greater than 60, 70, 80, 90, 95, 96, 97, 98 or 99% sequence identity to the heavy chain of 17C4/A3 (SEQ ID NO: 267) and/or having a light chain with greater than 60, 70, 80, 90, 95, 96, 97, 98 or 99% sequence identity with the light chain of 17C4/A3 (SEQ ID NO: 269). The present invention also includes nucleic acid molecules with greater than 60, 70, 80, 90, 95, 96, 97, 98 or 99% sequence identity to SEQ ID NO: 262, 264, 266, or 268.

These antibody sequences are full length sequences. The skilled person could use the variable domains or specifically the CDR regions of these antibodies to generate alternative antibodies such as humanised antibodies. The invention encompasses such antibodies.

The term "antibody" includes intact immunoglobulin molecules, as well as fragments thereof which are capable of binding an antigen. These include hybrid (chimeric) antibody molecules [208, 209]; F(ab')2 and F(ab) fragments and Fv molecules; non-covalent heterodimers [210, 211]; single-chain Fv molecules (sFv) [212]; dimeric and trimeric antibody fragment constructs; minibodies [213, 214]; humanized antibody molecules [215-217]; and any functional fragments obtained from such molecules, as well as antibodies obtained through non-conventional processes such as phage display. Preferably, the antibodies are monoclonal antibodies. Methods of obtaining monoclonal antibodies are well known in the art. Humanised or fully-human antibodies are preferred.

General

The practice of the present invention will employ, unless otherwise indicated, conventional methods of chemistry, biochemistry, molecular biology, immunology and pharmacology, within the skill of the art. Such techniques are explained fully in the literature. See, e.g., references 218-225, etc.

"GI" numbering is used above. A GI number, or "GenInfo Identifier", is a series of digits assigned consecutively to each sequence record processed by NCBI when sequences are added to its databases. The GI number bears no resemblance to the accession number of the sequence record. When a sequence is updated (e.g. for correction, or to add more annotation or information) then it receives a new GI number. Thus the sequence associated with a given GI number is never changed.

Where the invention concerns an "epitope", this epitope may be a B-cell epitope and/or a T-cell epitope. Such epitopes can be identified empirically (e.g. using PEPSCAN [226, 227] or similar methods), or they can be predicted (e.g. using the Jameson-Wolf antigenic index [228], matrix-based approaches [229], MAPITOPE [230], TEPITOPE [231, 232], neural networks [233], OptiMer & EpiMer [234, 235], ADEPT [236], Tsites [237], hydrophilicity [238], antigenic index [239] or the methods disclosed in references 240-244, etc.). Epitopes are the parts of an antigen that are recognised by and bind to the antigen binding sites of antibodies or T-cell receptors, and they may also be referred to as "antigenic determinants".

The term "comprising" encompasses "including" as well as "consisting" e.g. a composition "comprising" X may consist exclusively of X or may include something additional e.g. X+Y.

The word "substantially" does not exclude "completely" e.g. a composition which is "substantially free" from Y may be completely free from Y. Where necessary, the word "substantially" may be omitted from the definition of the invention.

The term "about" in relation to a numerical value x is optional and means, for example, x±10%.

Unless specifically stated, a process comprising a step of mixing two or more components does not require any specific order of mixing. Thus components can be mixed in any order. Where there are three components then two components can be combined with each other, and then the combination may be combined with the third component, etc.

Antibodies will generally be specific for their target. Thus they will have a higher affinity for the target than for an irrelevant control protein, such as bovine serum albumin.

References to a percentage sequence identity between two amino acid sequences means that, when aligned, that percentage of amino acids are the same in comparing the two sequences. This alignment and the percent homology or sequence identity can be determined using software programs known in the art, for example those described in section 7.7.18 of ref 245. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. 246.

BRIEF DESCRIPTION OF THE DRAWINGS

Figure 1A:
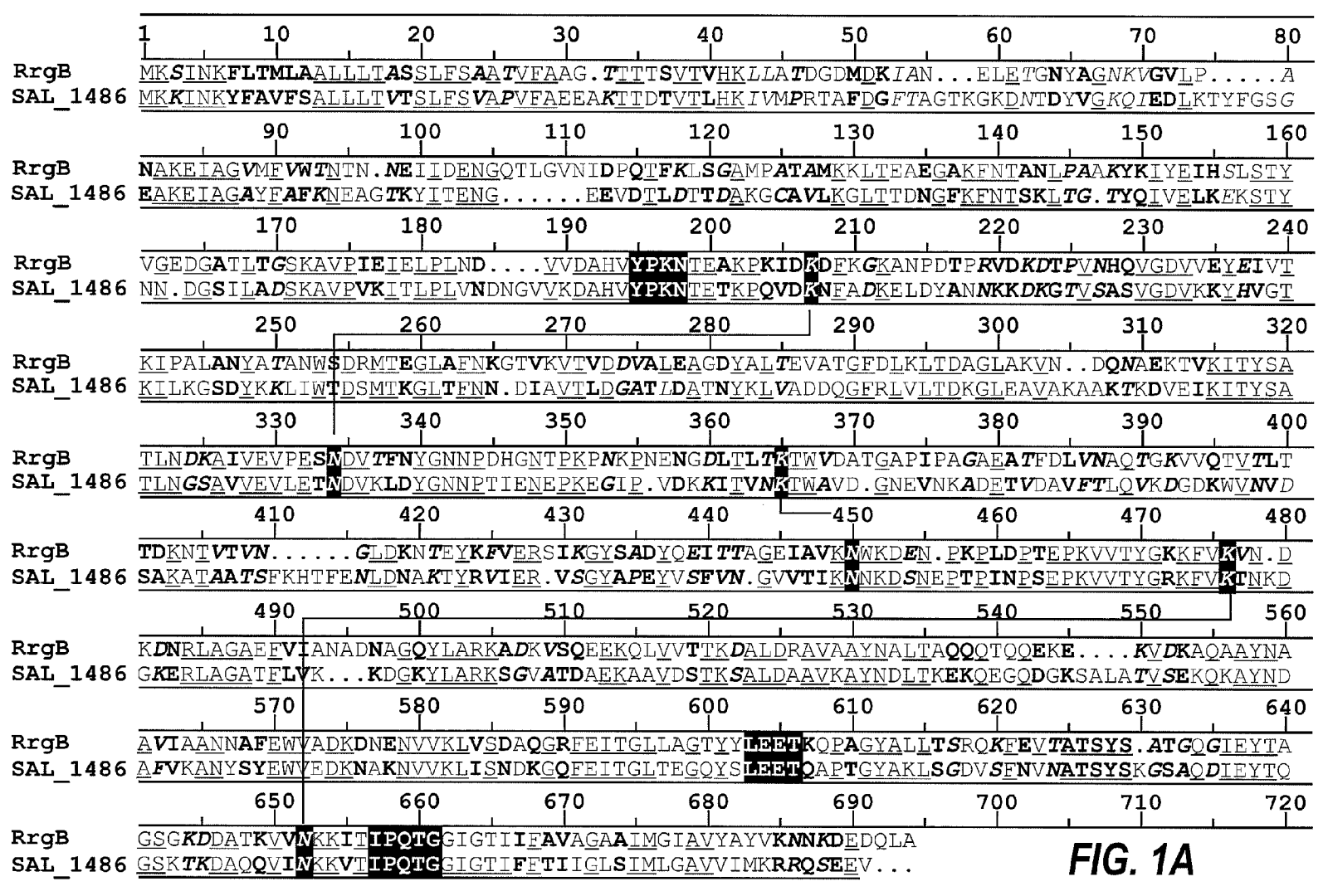

FIG. 1A, pairwise alignment between *S. pneumoniae* RrgB (SEQ ID NO:271) and *S. agalactiae* BP-2a 515 variant (SEQ ID NO:2).

FIG. 2: Identification of internal isopeptide bonds by MALDI TOF mass spectrometry. The recombinant protein BP-2a 515 variant was run on a 4-12% acrylamide SDS-PAGE. The protein was "in gel" digested with Lys-C. The peptides produced by the digestion were either directly analyzed by MALDI TOF mass spectrometry (upper panel) or were modified with O-methylisourea prior the analysis (lower panel). FIG. 3B, Opsonophagocytosis assay of mice antisera raised against BP-2a 515 variant with (WT) and without isopeptide bonds (ΔIB).

FIG. 5A, Superimposition of variants 515 and H36B. The best model for H36B variant (SAI_1511) after loop refinement reported a validation score of 165.3 compared with the expected high score value of 215 and low score value of 96.8. FIG. 5B, schematic representation of domains of BP-2a H36B variant FIG. 6A(i), D3 plus helices. FIG. 6B, schematic representation of fusion proteins. FIG. 6C, SDS-PAGE of purified recombinant fusion proteins detected by COOMASSIE® staining FIG. 6D, FACS analysis on GBS strains expressing different BP-2a variants with mouse antisera sera raised against fusion protein 6xD3.

FIG. 7: Crystal structure of BP-2a-515 solved and refined at 1.75 Å resolution via molecular replacement. Data collection and refinement statistics are shown in Table 2. The crystal asymmetric unit contains a dimer of two independent chains, each made up of three distinct domains: D2 (residues 190-332), D3 (residues 333-455) and D4 (residues 456-641). FIG. 7A, residues 192-640. FIG. 7B, residues 190-641). FIG. 7C(ii), IP2. FIG. 7C(iii), IP3. FIG. 7D(ii), mass spectrometry spectra (ITVNKTWAVDGNEVNK, amino acids 20-35 of SEQ ID NO:38). FIG. 7D(iii), mass spectrometry spectra (FVKTNK, amino acids 130-135 of SEQ ID NO:14; DAQQVINKK, amino acids 159-169 of SEQ ID NO:15).

MODES FOR CARRYING OUT THE INVENTION

Figure 1B:
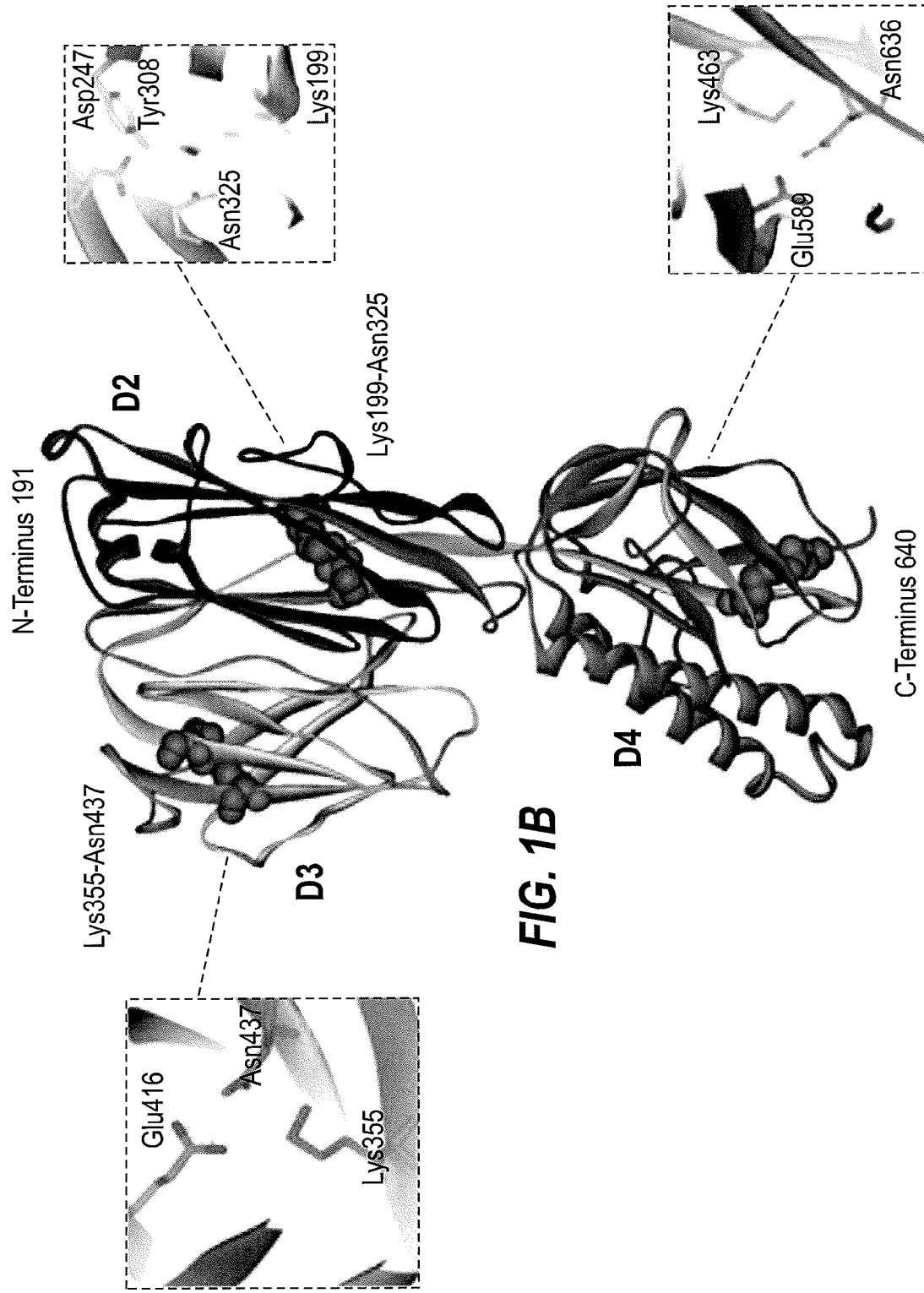
FIG. 1B, Model of BP-2a 515 variant.

*Streptococcus agalactiae* (Group B *Streptococcus* [GBS]) is the most common cause of sepsis and meningitis in neonates and is also the primary colonizer of the anogenital mucosa of healthy women. Recently, three pilus types have been discovered in GBS as important virulence factors. The genes involved in pilus assembly are clustered in characteristic genomic loci (named PI-1, PI-2a and PI-2b), each encoding three proteins containing a LPXTG (SEQ ID NO:272) motif representing the structural components of the pilus, and two sortase enzymes catalyzing protein polymerization. Each of the three pilus types carries two protective antigens. Among these, the backbone protein of pilus type 2a (BP-2a), showed the highest degree of gene variability and was able to significantly mediate opsonophagocytic activity and to confer protection in mice only against strains expressing the homologous allele. In order to map immunodominant and protective epitopes of the allelic variants of BP-2a, we performed a structural characterization of the protein by comparative homology modelling and on the basis of this structural information, we generated deletion mutants of the main variants corresponding to the four IgG-like fold domains identified. In vitro and in vivo studies showed that only the C-terminal portion of the protein was highly surface-exposed and able to elicit opsonophagocytic antibodies conferring protection in mice. In particular, domain D3 appeared to be the most important for the protective immunity of the main four allelic variants analyzed. Finally, we showed that a broad protective vaccine against GBS infection can be generated with a fusion protein containing D3 domains from different BP-2a variants.

Materials and Methods
Comparative Homology Modelling

All molecular simulations were performed using Discovery Studio 2.5 software from Accelrys, USA. The amino acid sequences of the BP-2a (515 variant, TIGR annotation SAL_1486 and H36B variant, TIGR annotation SAI_1511) were used to search against the Protein Data Bank (PDB) with the BLAST program tool [247]. The best template structure for both protein sequences for homology modelling resulted to be the crystal portion (residues 187 to 627) of RrgB (PDB code: 650), the backbone protein of *S. pneumoniae* pilus, that was obtained from the PDB database. Pairwise sequence alignment between SAL_1486 and RrgB and between SAI_1115 and RrgB were done using multiple sequence alignment tool in DS 2.5 followed by manual modifications to improve the alignment quality. The models were generated with MODELER [248] from protein modelling module of DS 2.5, performing both homology modelling and loop refining for the protein. Ten models have been generated and the model which shared the least RMS deviation with respect to trace (Cα atoms) of the crystal structure of the template, was selected for further refinements and validations. The quality of the refined structure obtained for SAL_1486 was checked with verify Profile-3D module in DS 2.5, and its stereochemical quality was examined by Ramachandran plot using DS 2.5. In order to optimize particular loop regions in the generated structure for SAI_1511, the loop refinement module, based on CHARMm and Looper molecular mechanics, of DS 2.5 was used. Finally, the model structures generated have been superimposed using Align Structures module of DS 2.5.

Protein Crystallization

Crystallization trials were set up in 96-well microbatch plates (Greiner) using the Orxy 8.0 crystallization robot (Douglas Instruments). Crystals of BP-2a-515 grew after one to two weeks at 20° C. in a 0.5 μl drop consisting of 0.3 μl protein (180 mg/ml) in 10 mM HEPES pH 7.0 and 0.2 μl crystallization solution (25% (w/v) PEG 4000, 0.1 M HEPES pH 7.0 and 90 mM potassium sodium tartrate tetrahydrate), layered with silicon oil and paraffin, mixed at a ratio of 1:1. Crystals were cryoprotected in the crystallization solution containing increased precipitant concentration (40% (w/v) PEG4000). Crystals belong to the orthorhombic $P2_12_12_1$ space group with two BP-2a 515 chains present in the asymmetric unit, and an estimated solvent content of 53%.

Structure Solution and Refinement

Diffraction data from a single crystal were collected at a resolution of 1.75 Å at the European Synchrotron Radiation Facility (Grenoble, France; beam line ID23-1). Data were processed using imosflm (32) and SCALA (33) available from the CCP4 Program Suite (34). The crystal structure of BP-2a-515 was solved by molecular replacement using the program Molrep (35) and the structure of the pilus backbone protein (RrgB) from *S. pneumoniae* (15) (PDB 2X9W), as a search model. The intial Molrep output model was extended using ARP/wARP (36). The structure was refined using REFMAC 5 (37) and modeled to electron density maps using Coot (38). The latter stages of refinement included the translational-libration-screw (TLS) option (39). During model building and refinement, it became apparent that the protein had been cleaved at the N-terminus, lacking approximately 190 residues, as previously observed for RrgB (15). The final model displays optimal stereochemical geometric parameters with 99.1% of residues in the most favorable regions of the Ramachandran plot, with no outliers, according to validation carried out using MolProbity (molprobity.biochem.duke.edu/) (40, 41). Atomic coordinates and structure factors for residues 190-640 of BP-2a-515 have been deposited in the Protein Data Bank, Research Collaboratory for Structural Bioinformatics, Rutgers University, New Brunswick, N.J. (www.rcsb.org) under accession code 2XTL (Reference to add PDB: Berman, H. M., et al., The Protein Data Bank. Nucleic Acids Res, 2000. 28(1): p. 235-42.).

Bacterial Strains and Growth Conditions

The GBS strains used in this work were 2603 V/R (serotype V), 515 (Ia), CJB111 (V), H36B (serotype Ib), 5401 (II) and 3050 (II). Bacteria were grown at 37° C. in Todd Hewitt Broth (THB; Difco Laboratories) or in trypticase soy agar supplemented with 5% sheep blood.

Cloning, Expression, Purification of Recombinant Proteins and Antisera.

GBS strains 515 and H36B were used as source of DNA for cloning the sequences coding for the single domains (D1, D2, D3 and D4) of the BP-2a 515 and H36B allelic variants. Genomic DNA was isolated by a standard protocol for gram-positive bacteria using a NucleoSpin Tissue kit (Macherey-Nagel) according to the manufacturer's instructions. Genes corresponding to each domain were first cloned into pENTR™/TEV/D-TOPO vector (Invitrogen) and then subcloned into pET54 DEST vector (N-terminal 6xHIS tag) or pET59 DEST (N-terminal 6xHis-TRX tag) (Novagen) using the GATEWAY cloning system (Invitrogen), with the exception of D3 domain of SAI_1511, which was cloned in the pSpeedET vector by PIPE cloning method [249]. The oligos used are listed in Table 1. The resulting constructs were checked for sequencing and then transformed into *E. coli* BL21(DE3) (Novagen) for the expression as 6His- or TRX-tagged fusion proteins.

The full length recombinant BP-2a proteins, corresponding to 515, CJB111 and 2603 allelic variants (TIGR annotation SAL1486, SAM1372 and SAG1407, respectively), were produced as previously reported [2], while the full length H36B variant (TIGR annotation SAI_1511) was cloned in pET24b+ (Novagen) using strain H36B as source of DNA. Primers were designed to amplify the coding regions without the signal peptide and the 3' terminal sequence starting from the LPXTG (SEQ ID NO:272) motif.

The genes coding for the BP-2a fusion proteins, 6XD3 and 4XD3-H, were synthetically constructed from GENEART. The 6XD3 gene was then cloned into pET15 vector adapted in house using PIPE cloning in *E. coli* HK100 strain. The 4XD3-H gene was sub-cloned using NdeI and XhoI restriction enzymes into the expression vector pColdI (N-terminal 6xHIS-tag, Takara). The final constructs were sequenced and transformed in BL21(DE3) (Novagen).

For the recombinant protein expression, the cultures were maintained at 25° C. for 5 h after induction with 1 mM IPTG for the pET clones or with 0.2% arabinose for the SpeedET clones. All recombinant proteins were purified by affinity chromatography and gel filtration. Briefly, cells were harvested by centrifugation and lysed in "lysis buffer", containing 10 mM imidazole, 1 mg\ml lysozyme, 0.5 mg\ml DNAse and COMPLETE inhibitors cocktail (Roche) in PBS. The lysate was clarified by centrifugation and applied onto His-Trap HP column (Armesham Biosciences) pre-equilibrated in PBS containing 10 mM imidazole. Protein elution was performed using the same buffer containing 250 mM imidazole, after two wash steps using 20 mM and 50 mM imidazole buffers. The eluted proteins were then concentrated and loaded onto HiLoad 16/60 Superdex 75 (Amersham Biosciences) pre-equilibrated in PBS. For the expression of the 4XD3-H was maintained at 37° C. until OD 600 nm reached the value of 0.7 and after induction in the presence of 1 mM IPTG, the temperature was switched to 20° C. and the culture was maintained at this temperature overnight. Protein concentration of the pure fractions was estimated using BCA assay (PIERCE).

Antisera specific for each protein were produced by immunizing CD1 mice with the purified recombinant proteins as previously described [250]. Protein-specific immune responses (total Ig) in pooled sera were monitored by ELISA.

Site-Directed Mutagenesis

For the generation of the mutated form of BP-2a 515 variant, containing the lysine residues involved in the isopeptide bonds mutated into alanine, mutations were introduced into the wild type BP-2a 515 variant carrying the LPXTG (SEQ ID NO:272) motif. Primers used for the amplification of the gene coding for BP-2a 515 with LPXTG (SEQ ID NO:272) motif are listed in Table 1. Site-directed mutagenesis was performed using the PIPE method and forward and reverse primer pairs for each mutation were designed, as listed in Table 1. The wild type protein and the mutated form, were cloned into SpeedET vector (N-term 6xHis tag) and expressed in *E. coli* HK100 strain. The sequences of the resulting constructs were confirmed by DNA sequencing. Proteins were purified by affinity chromatography and gel filtration as described above.

Flow Cytometry

Mouse sera raised against purified deletion mutant of the 515 and H36B variants were analyzed on whole bacteria by flow cytometry to evaluate the surface-exposure of the corresponding domains. Exponential phase bacterial cells were fixed in the presence of 0.08% (wt/vol) paraformaldehyde and incubated for 1 h at 37° C. Fixed bacteria were then washed once with PBS, resuspended in Newborn Calf Serum (Sigma) and incubated for 20 min. at 25° C. The cells were then incubated for 1 hour at 4° C. in preimmune or immune sera, diluted 1:200 in dilution buffer (PBS, 20% Newborn Calf Serum, 0.1% BSA). Cells were washed in PBS-01% BSA and incubated for a further 1 h at 4° C. with a 1:100 dilution of R-Phycoerythrin conjugated F(ab)2 goat anti-mouse IgG (Jackson ImmunoResearch Laboratories; Inc.). After washing, cells were resuspended in PBS and analyzed with a FACS Calibur apparatus (Becton Dickinson, Franklin Lakes, N.J.) using FlowJo Software (Tree Star, Ashland, Oreg.). Data are expressed as the difference in fluorescence between cells stained with immune sera versus pre-immune sera.

Immunoblotting

Group B *Streptococcus* strains were grown overnight in THB (Difco Laboratories, Detroit, Mich.) to exponential phase (OD600=0.5). Bacteria were pelleted, washed in PBS and resuspended in 50 mM Tris-HCl, containing 400 units of mutanolysin (Sigma-Aldrich). Bacterial suspension was then incubated 2 h at 37° C. and lysed by freeze and thaw. Cellular debris were removed by centrifugation at 14 000 rpm for 10 min and protein concentration measured by Bio-Rad Protein assay. Total cell proteins were separated by 4-12% NuPage Novex pre-cast gels (Invitrogen) and electroblotted onto PVDF membranes using the iBlot™ Dry Blotting System (Invitrogen). After blocking in 1× phosphate-buffered saline (PBS: 140 mM NaCl, 2.7 mM KCl, 10 mM Na2HPO4 and 1.8 mm KH2PO4, pH 7.3) containing 0.05% Tween 20 and 10% skim milk for 1 h at room temperature, membranes were incubated for 1 h at room temperature (RT) with primary antibodies diluted 1:500. After washing three times in PBS containing 0.05% Tween 20 (PBST), the membranes were incubated for 1 h with horseradish peroxidase-conjugated secondary antibodies (Dako). Positive bands were visualized with the Opti-4CN Substrate Kit (Bio-Rad).

Opsonophagocytosis Assay

The opsonophagocytosis assay was performed using differentiated HL-60 as phagocytic cells and strains 515, CJB111, 3050 and 5401 as target cells. GBS strains were grown in Todd-Hewitt broth (THB) to mid-exponential growth phase (A650 nm=0.3). The bacteria were harvested by centrifugation, washed twice with cold saline solution, and finally resuspended in HBSS buffer (Invitrogen) to a concentration of ≈1.2×10$^7$ CFU/ml. Promyelocytic HL-60 cells (ATCC, CCL-240) were expanded in RPMI 1640 (Gibco, Invitrogen) containing 10% Fetal clone I (HyClone) at 37° C. with 5% $CO_2$ and differentiated into granulocyte-like cells to a density of 4×10$^5$ cells/ml by the addition of 100 mM N, N dimethylformamide (DMF, Sigma) to the growth medium. After 4 days, cells were harvested by centrifugation and resuspended in HBSS buffer to a concentration of ≅4×10$^7$ cells/ml. In brief, the reactions took place in a total volume of 125 µl containing ≈3×10$^6$ differentiated HL-60, ≈1.5×10$^5$ CFU of GBS cells, 10% baby rabbit complement (Cedarlane), and heat-inactivated mouse antisera at 37° C. for 1 h with shaking at 600 rpm. Immediately before and after 1 h of incubation, a 25-µl aliquot was diluted in sterile distilled water and plated onto trypticase soy agar plates with 5% sheep blood. A set of negative controls included in each experiment consisted of reactions containing preimmune sera, reactions without HL-60, and reactions with heat-inactivated complement. The amount of opsonophagocytic killing (log kill) was determined by subtracting the log of the number of colonies surviving the 1 h assay from the log of the number of CFU at the zero time point.

Mouse Active Maternal Immunization Model

A maternal immunization/neonatal pup challenge model of GBS infection was used to verify the protective efficacy of the produced proteins in mice, as previously described (Maione et al., 2005). Briefly, CD-1 female mice (6-8 weeks old) were immunized on days 1 (in CFA), 21 and 35 (IFA) with either PBS or 20 mg of recombinant protein and were then bred 3 days after the last immunization. Within 48 h of birth, pups were injected intraperitoneally with a dose of different GBS strains calculated to cause 90% lethality. Survival of pups was monitored for 2 days after challenge. Statistical analysis was performed using Fisher's exact test. All animal studies were performed according to guidelines of the Istituto Superiore di Sanità (Italy).

Results

We have previously shown that the Backbone Protein of pilus 2a (BP-2a) in Group B Streptococcus is able to confer protection in an active maternal/pup challenge model in mouse [1]. However, the existence of seven highly variable allelic variants and the demonstration that each variant confers protection only against the homologous strain restricts the possibility of using this antigen alone or in combination with other antigens in a broad-spectrum vaccine against GBS [2]. Nevertheless, BP-2a is an antigen of interest since it is able to promote high levels of opsonic killing of GBS when tested in an opsonophagocytosis assay in the presence of specific antibodies. We used this specific feature in order to explore the protective capability of this antigen and identify the immunodominant epitopes of BP-2a.

Comparative Homology Modelling of the BP-2a 515 Variant

In order to design appropriate deletion mutants of BP-2a, we performed a structural characterization of the protein, first focusing on the 515 variant (TIGR annotation SAL_1486), by comparative homology modelling. The PDB was searched for a protein sharing significant sequence identity with BP-2a. The best template structure found was PBD code 650 corresponding to the RrgB pilus protein of S. pneumoniae. The RrgB crystal comprises the region from residues 187 to 647 and it is arranged in three immunoglobulin-like domains, each one carrying a stabilizing isopeptide bond. The first two domains (D2 and D3) are closely packed to form a compact structure from which two anti-parallel helixes and the third domain (D4) protrude. The PDB 650 crystal does not include the first domain (D1) of the RrgB protein.

The amino acid sequences of BP-2a 515 variant and RrgB were aligned and reported to share 43% sequence identity and 61% sequence similarity. Sequence comparison revealed that the pilin motif YPK, the E-Box cassette, the LPXTG (SEQ ID NO:272) motif and all the residues involved in isopeptide bonds are well conserved (FIG. 1A). The pairwise alignment was further manually optimized to cope with the secondary structures in order to refine the homology modelling procedure input. The quality of the model was assessed by calculating the compatibility score with Profile-3D module (Discovery Studio 2.5 Software Inc., San Diego, Calif.). The template reported a score of 168.6 compared with the expected high score value of 201.7 and low score value of 90.7. The best model for BP-2a-515 reported a validation score as computed by Profile-3D of 154, while the minimum and the maximum possible scores for this model are 92.2379 and 204.973, respectively. Given that even the template crystal structure does not reach the expected score for the correctly folded protein, the model obtained a validation score comparable to the crystal one.

As shown in FIG. 1B, the model of our protein, corresponding to amino acid residues 191 to 640, revealed three IgG-like fold domains (D2, D3 and D4), each one characterized by a stabilizing isopeptide bond. Superimposing the template structure against the generated model, a RMSD as low as 1.2 Å is obtained, meaning that the sequence of BP-2a fitted well in the template structure. Only minor differences in loops were identified, all due to short residue insertions or deletions. Moreover, the superimposition of crystallized isopeptide bonds shows that the region in the vicinity of the bonds is relatively conserved. In particular, there is a glutamic acid or an aspartatic acid which catalyze bonds, completely immersed in a surrounding hydrophobic cavity. In the BP-2a 515 variant, the residues involved in isopeptide bonds are: Lys199-Asn325 in the D2 domain with Asp 247 as the catalyzing and stabilizing residue; Lys355-Asn437 in the D3 domain with Glu416; and Lys463-Asn636 in the D4 domain with Glu589. Based on secondary structure and fold prediction of the N-terminal portion of the BP-2a protein (residues 1 to 190), we hypothesise that this portion has the same IgG-like fold of D2, D3 and D4 (data not shown).

Mass Spectrometry Analysis Confirms the Presence of Three Internal Isopeptide Bonds Recombinant full length SAL_1486 was purified and used to confirm the presence of the isopeptide bonds hypothesized from the modelling study. The method selected for their identification was based on the total digestion of the diverse constructs with Lys-C and analysis of the digestion products by mass spectrometry. In order to easily sort the bond peptides, the digestion products were derivatized with O-methylisourea that modifies the C-terminal lysine in homoarginine with a mass increase of 42 Da for each modified C-terminal extremity. Isopeptide bonded peptides are those presenting a shift of mass of 42 D (partial derivatization) and 84 Da (complete derivatization). The protein was resistant to "in solution" enzymatic digestions (data not shown). The approach that allowed the larger peptide coverage was obtained from "in gel" digestion of the polypeptide run on SDS-PAGE. FIG. 2 reports the mass spectrometry spectra obtained from the full length recombinant SAL_1486 allowing the confirmation of the hypothesized isopeptides.

Figure 2A:
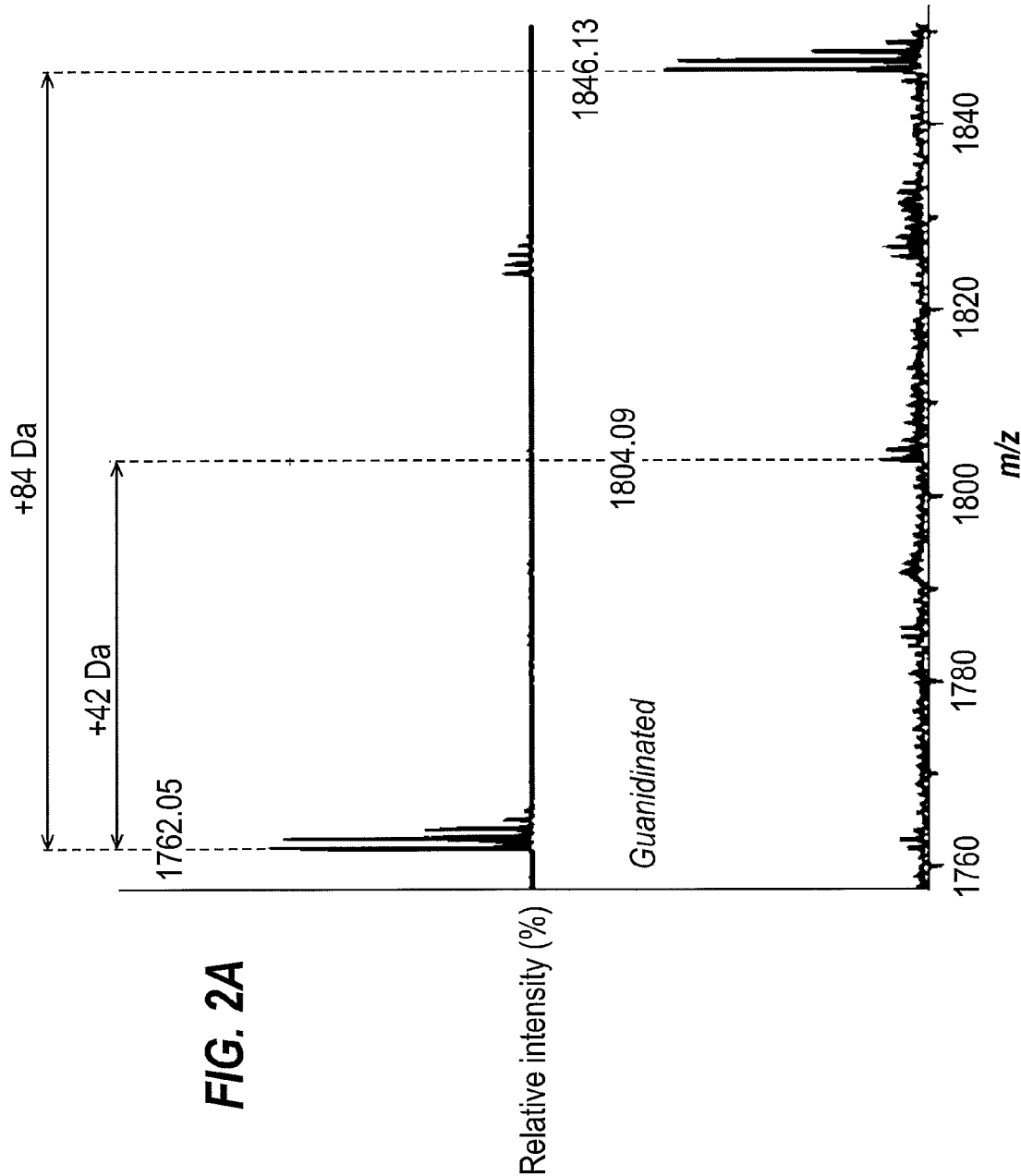
FIG. 2A, Signal for isopeptide bonded peptides in domain D4 (A)
Figure 2B:
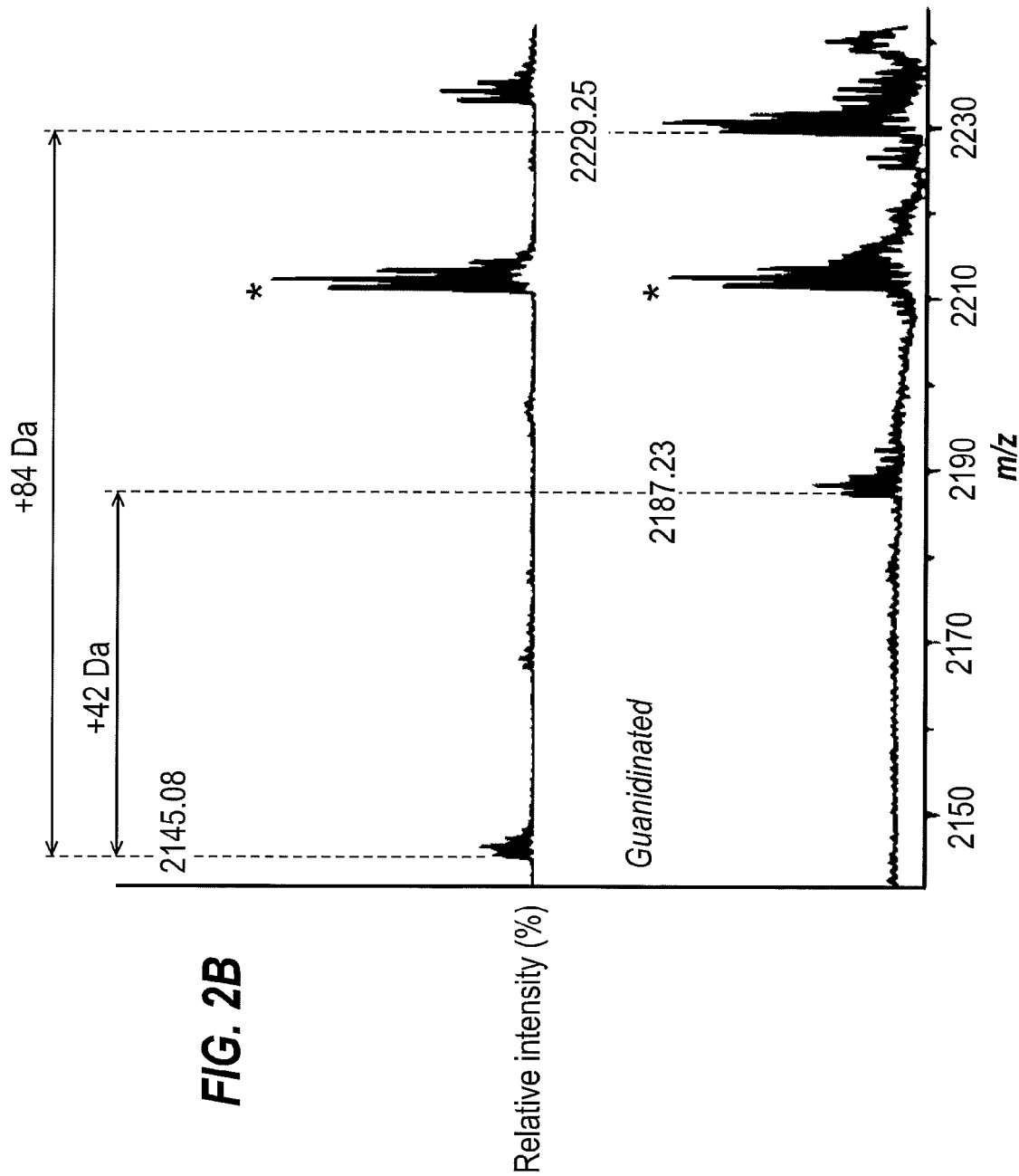
FIG. 2B, Signal for isopeptide bonded peptides in domain D2.
Figure 2C:
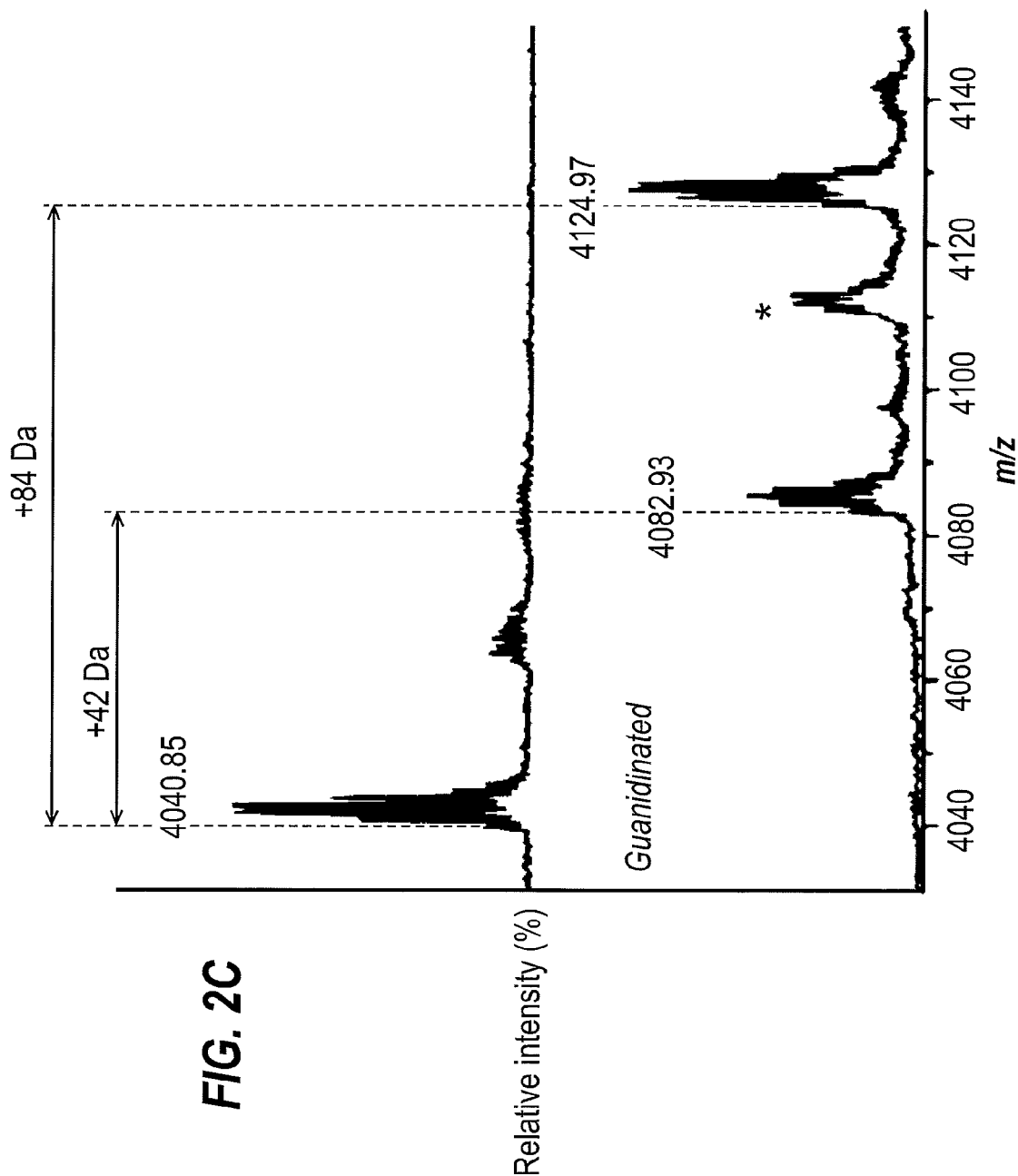
FIG. 2C, Signal for isopeptide bonded peptides in domain D3 were observed. (♦) Trypsin autodigestion product. (*) Peak not identified FIG. 3A, SDS-PAGE of purified recombinant BP-2a 515 variant with (WT) and without isopeptide bonds (ΔIB).

An isopeptide bond involving amino acids carried by the D4 domain of the protein was evidenced by the molecular ion of m/z 1762.05 Da that corresponds to the molecular mass of the peptide $^{461}$FVKTNK$^{466}$ (amino acids 130-135 of SEQ ID NO:14) linked by an isopeptide bond to the peptide $^{630}$DAQQVINKK$^{638}$ (amino acids 159-169 of SEQ ID NO:15) (expected molecular mass 1761.90 Da) (FIG. 2A, upper panel). The guanidination reaction induced a shift of 42 and 84 Da of the signal that corresponds to the single and double C-terminal peptide derivatization, respectively, confirming the covalent linkage of the two peptides. In the same way, isopeptide bonds in domains D2 and D3 were assigned from the ions of m/z 2145.18 and 4040.85 that correspond to the molecular mass of peptide $^{53}$ITVNKTWAVDGNEVNK$^{68}$ (amino acids 20-35 of SEQ ID NO:38) linked to peptide $^{139}$NNK$^{141}$ (expected molecular mass 2145.13 Da), and of peptide $^{185}$ITYSATLNGSAVVEVLETNDVK$^{206}$ (amino acids 152-173 of SEQ ID NO:56) linked by an isopeptide bond to the peptide $^{68}$NTETKPQVDKNFADK$^{82}$ (amino acids 21-34 of SEQ ID NO:57) (expected molecular mass 4040.07 Da), respectively (FIGS. 2B and 2C). The guanidination reaction confirmed the covalent linkage of the peptides by the double shift of mass of 42 and 84 Da. It was noteworthy that no isopeptide bond was identified in the N-terminal part corresponding to domain D1 of the full-length recombinant protein.

In order to confirm that the lysines involved in the isopeptide bonds of domains D2, D3 and D4 corresponded exactly to K199, K355 and K463 predicted by structural model, we generated a recombinant form of the protein by site-directed mutagenesis in which these lysine residues were mutated into alanine residues (K199A/K355A/K463A). The same protocol of enzymatic digestion and mass spectrometry analysis was applied, and none of the signals, corresponding with isopeptide linked peptides and reported above, were identified (data not shown).

X-Ray Crystal Structure of BP-2a-515 Pilus Subunit

Figure 7C:
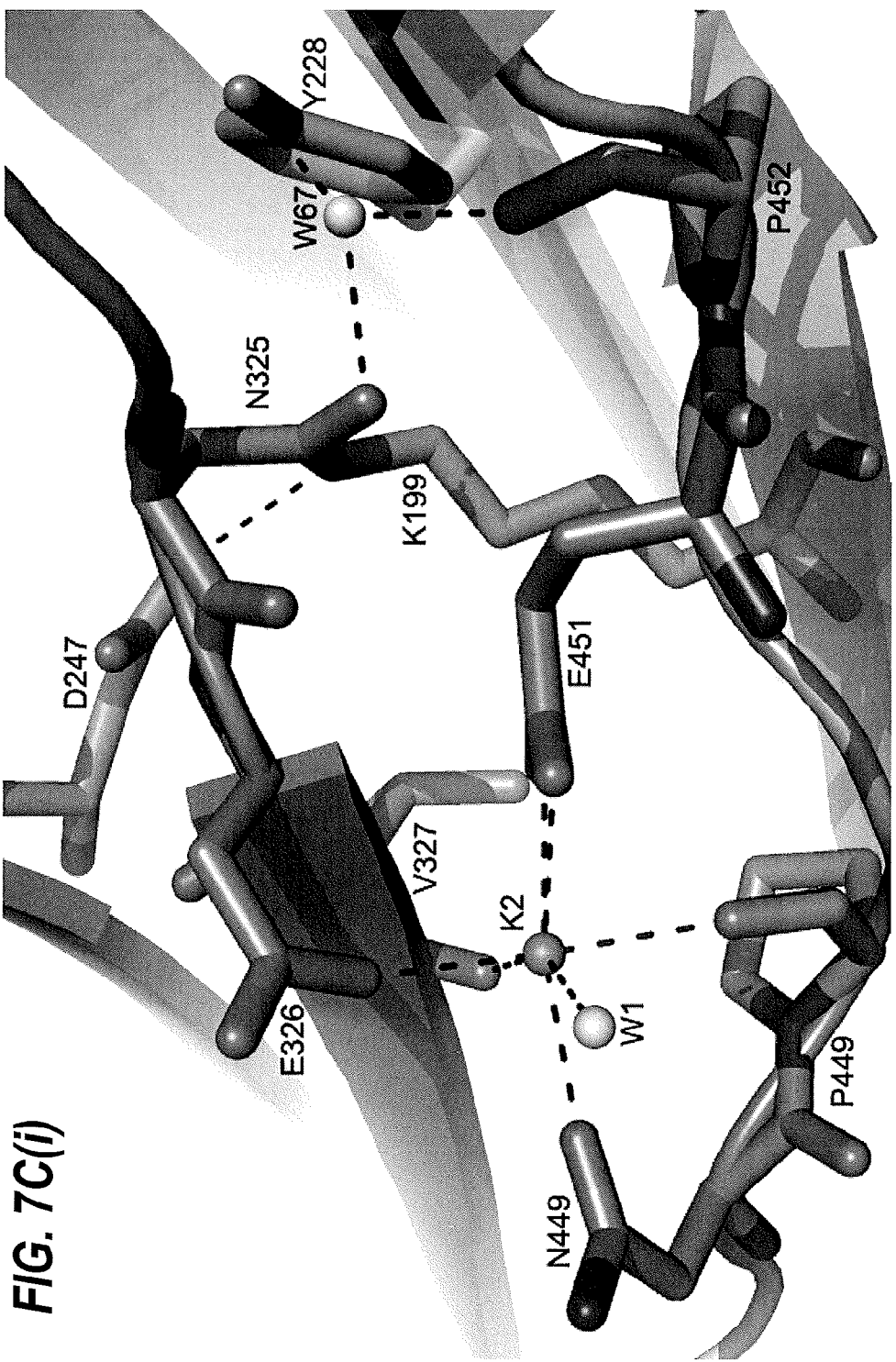
FIG. 7C(i), IP1.
Figure 7D:
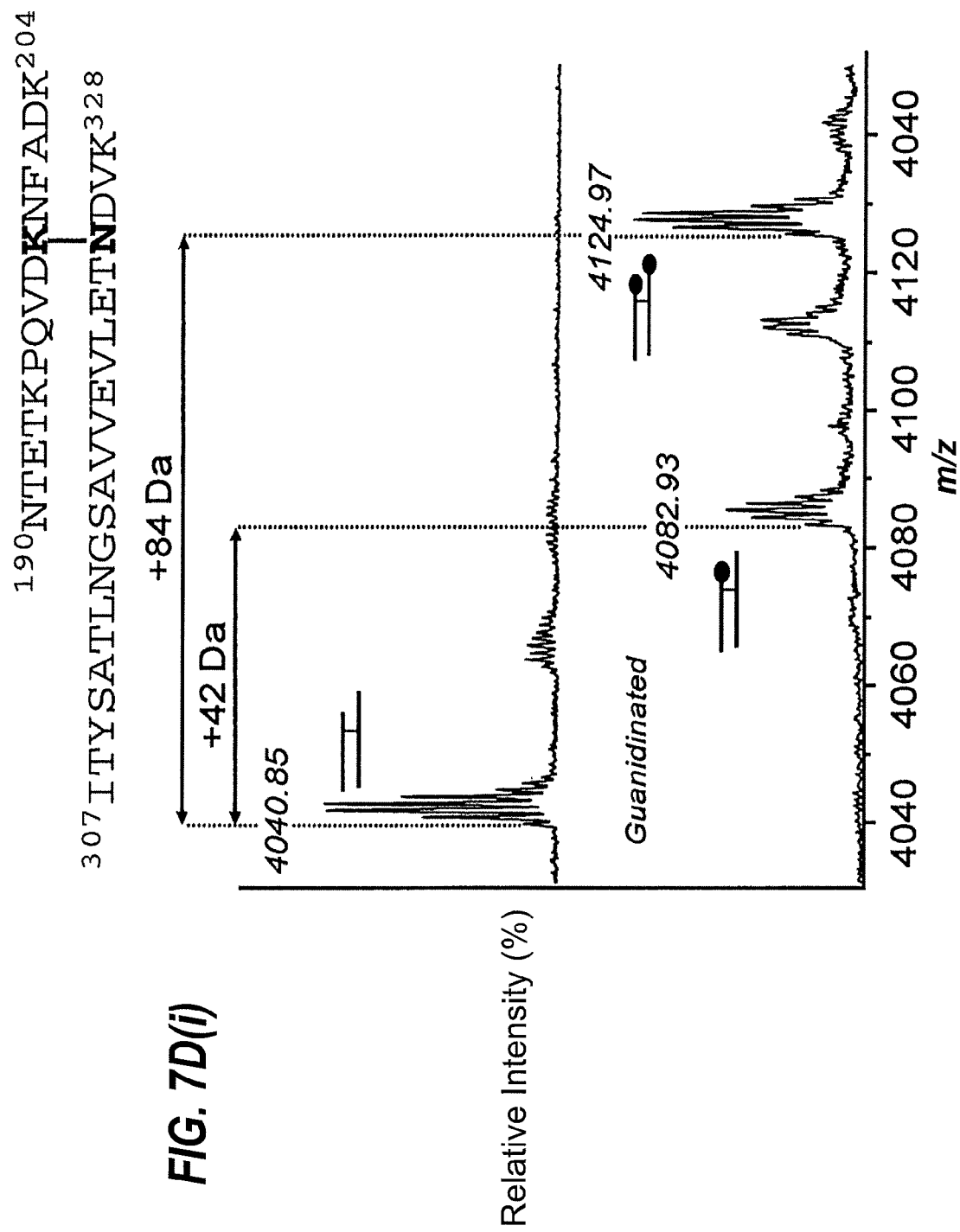
FIG. 7D(i), mass spectrometry spectra (NTETKPQVDKNFADK, amino acids 21-34 of SEQ ID NO:57; ITYSATLNGSAVVEVLET-NDVK, amino acids 152-173 of SEQ ID NO:56).

With the aim to identify the domain(s) carrying the protective epitopes, the crystal structure of BP-2a-515 was solved and refined at 1.75 Å resolution via molecular replacement. Data collection and refinement statistics are shown in Table 2. The crystal asymmetric unit was confirmed to contain a dimer of two independent chains (A: residues 192-640 and B: residues 190-641), each made up of three distinct domains: D2 (residues 190-332), D3 (residues 333-455) and D4 (residues 456-641) (FIG. 7). The observed BP-2a-515 dimer does not display extensive intermolecular interactions at the association interface, therefore the dimer is not expected to occur in solution and it is a likely consequence of crystal packing, as indicated by the Protein Interfaces, Surfaces and Assemblies (PISA) Service [251] at the European Bioinformatics Institute (www.ebi.ac.uk/msd-srv/prot_int/pistart.html).

Although crystallization was carried out using the full-length protein, approximately 190 amino acids from the N-terminus (D1 domain) were absent in the crystal, suggesting that they are cleaved off prior to crystallization. A similar behavior was reported for the pneumococcal RrgB pilus protein whose structure was recently solved at 1.6 Å resolution [252] and is highly homologous to the structure of BP-2a-515.

Potassium-sodium tartrate present in the crystallization solution was relevant for optimizing crystal growth and improving diffraction resolution. In fact, three potassium cations are bound at strategic and stabilizing positions in the structure. Two (identically-coordinated) potassium cations are bound to the D2 domain in both chains and stabilize a flexible linker, connecting the D3 and D4 domains, via contributing residues from domains D2, D3, and a water molecule (FIG. 7). The third potassium cation stabilizes a flexible loop in the D4 domain from chain A.

The organization of the three domains was confirmed to show a modified IgG fold [252], a structural feature already observed for RrgB of S. pneumoniae. Indeed, superimposition of the C-alpha atoms of BP-2a-515 chain B and RrgB using the pairwise structural alignment C-alpha match program (bioinfo3d.cs.tau.ac.il/c_alpha_match/), yields a r.m.s.d value of 1.37 Å over 280/452 residues. The major structural differences between the two proteins regard the spatial location of the D3 domain, the movement of two α-helices in the D4 domain that are connected to the β-sandwich by two β-strands not present in RrgB, and flexible regions.

Similarly to RrgB, each domain is characterized by a stabilizing, covalent intramolecular isopeptide bond, formed between the ε-amino group of lysine side chains and the δ-carboxyamide group of asparagine. The three isopeptide bonds occur between Lys199 and Asn325 (D2 domain), Lys437 and Asn355 (D3 domain), and Lys463 and Asn636 (D4 domain), and stabilize the secondary structural elements of their respective domains. Due to the conformational movement of D3 in comparison with RrgB, the latter isopeptide bond is the only one that does not match the spatial location of the equivalent bond in RrgB. The surrounding area around these bonds is largely hydrophobic, comprising several aromatic residues, in agreement with observations made for the isopeptide bonds in several pilus proteins.

Each of the four domains D1, D2, D3 and D4 appear to fold independently. This was demonstrated by expressing and purifying each domain from E. coli, as independent constructs whose N and C termini were selected on the basis of the domain boundaries defined in the crystal structure of BP-2a-515. All four domains were expressed in soluble form in E. coli, and Mass Spectrometry analysis of tryptic digests of D2, D3 and D4 revealed that the domains carried the same isopeptide bonds found in the full-length protein data not shown). This suggested that the overall structural organization of the independently expressed domains was sufficiently preserved to bring the lysine and asparagine residues at a suitable reaction distance.

In conclusion, the crystal structure of the backbone subunit of PI-2a (515 allele) indicates that the protein is organized into four domains, which are shown to be independently structured and stable.

Intramolecular Isopeptide Bonds are Dispensable for Protection

It has been demonstrated that intramolecular isopeptide bonds that are dispensable for pilus assembly, contribute to structural and proteolytic stability of pili. The SDS-PAGE of the wild-type and mutated BP-2a protein showed that the protein without isopeptide bonds had a slower electrophoretic mobility compared to the wild-type form. The presence of internal cross-links within the naïve protein may make the wild-type protein structure more compact and more able to pass through the matrix of the gel, whereas the mutated form has a larger structure which runs to a higher molecular weight (FIG. 3A).

In order to evaluate if the presence of these internal linkages could influence the protective capability of the protein BP-2a and investigate if the mutant protein is able to induce protective immunity in vivo as well as the wild type, we tested both proteins in a mouse maternal immunization model [250]. We immunized groups of adult female CD1 mice with the purified recombinant proteins and after three immunizations, mice were mated and the resulting offspring were challenged with a dose of GBS calculated to kill about 90% of the pups. The high levels of protection observed with the mutated form of the protein (Table 3) revealed that the loss of isopeptide bonds did not interfere with capacity of the protein to confer protection in mice and to elicit opsonic antibodies (FIG. 3B).

Domain D3 is Highly Surface Exposed and Essential for Protection

Based on the information obtained from the structural model described above, we generated four deletion mutants of the BP-2a 515 variant, dividing the protein in four overlapping fragments corresponding to the four IgG-like domains predicted by modelling (FIG. 4A): D1 corresponds to the region from amino acids 30 to 162; D2 corresponds to the region from amino acids 156 to 338; D3 corresponds to the region from amino acids 332 to 499; and D4 corresponds to the region from amino acids 457 to 640.

The deletion fragments were cloned, expressed in E. coli and purified as HIS- or TRX-tagged recombinant proteins, as described in Materials and Methods. Interestingly, the isopeptide bonds present into domains D2 and D3 and D4 were also identified in the single recombinant forms of these domains, indicating that the single domain had all the requirements for the formation of this covalent bond (data not shown).

Figures 4A, 4B, 4C:
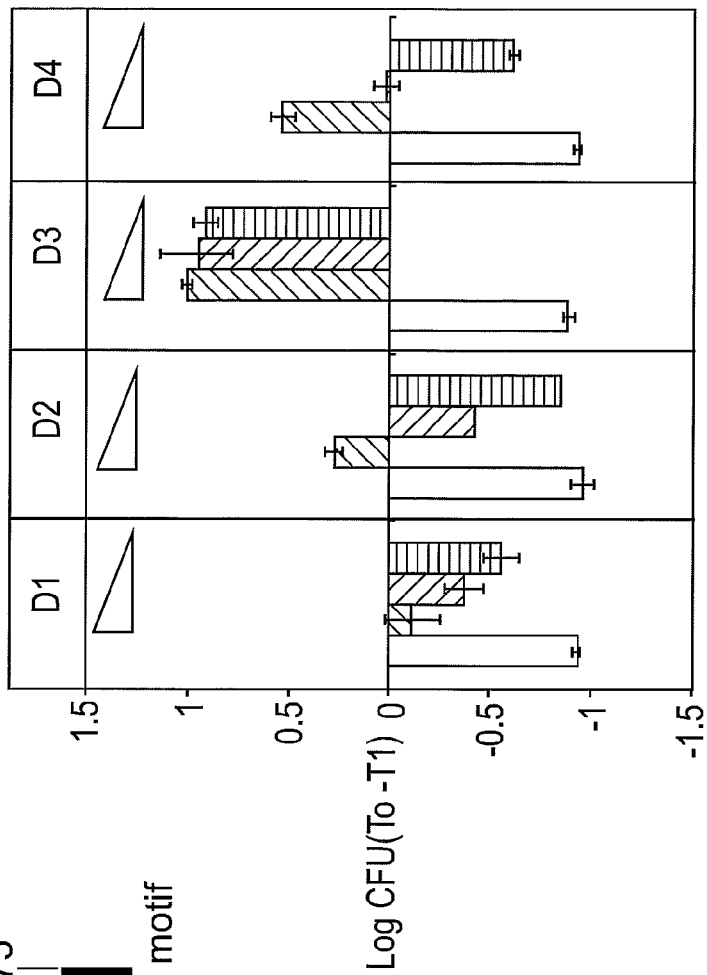
FIG. 4A, schematic representation of four domains of BP-2a-515 variant.
FIG. 4B, FACS analysis on 515 GBS strain with mouse sera raised against each BP-2a domain.
FIG. 4C, Opsonophagocytosis assay with mouse sera raised against each domain of BP-2a-515 variant.

The four purified soluble domains were used for immunizing CD1 mice and protein-specific immune responses (i.e., the total immunoglobulin level) were monitored by ELISA and Western Blotting. Sera raised against each fragment were also analyzed by flow cytometry using whole bacteria strain 515 in order to evaluate which domain was exposed on the polymerized pilus protruding from bacterial surface. As shown in FIG. 4B, domains D3 and D4 were highly exposed at a level comparable to those observed with the antiserum raised against the full length protein. A weak shift was obtained using antibodies anti-D2 suggesting it is not highly exposed, whereas D1 was not exposed.

To investigate which of the domains were able to confer protection against GBS infection, we performed an in vitro opsonophagocytosis analysis using sera from immunized mice and an in vivo active maternal mouse immunization/neonatal pup challenge model. According to the FACS results, only domains D3 and D4 domains were able to elicit opsonophagocytic antibodies and confer protection in mice against GBS infection (FIG. 4C and Tables 3 and 4). In particular, domain D3 showed the highest level of surface exposure and opsonic activity.

The selection of FACS positive and opsonic mAbs mapping in the D3 domain confirmed that the C-terminal portion of the protein and in particular D3 is essential for protective immunity (data not shown).

Domain D3 Represents the Immunodominant Epitope of the Main Allelic Variants of BP-2a We have observed that all the allelic variants described so far, sharing a sequence homology ranging from 48% to 98%, were protective in mouse model, although they protected only pups challenged with strains carrying the allelic variant used to immunize the respective mothers ([2] and data not shown).

To investigate if the results obtained with the 515 allele were confirmed in the other variants, we applied the same approach described above to map the immunodominant portion in the most representative variants (named 515, CJB111, H36B and 2603) belonging to the two major families.

In order to understand if the BP-2a variants shared the same structural organization, a new structural model of the H36B allele (TIGR annotation SAI_1511), was generated. This variant was chosen because it is the most divergent in terms of sequences identity and similarity, from the 515 variant (48% of sequence identity). The RrgB pilus protein of S. pneumoniae was used as template structure (PDB code: 650). The amino acid sequences of SAI_1511 and RrgB were aligned and reported to share 38% sequence identity and 56% sequence similarity. The model of SAI_1511, as reported in FIG. 5A, revealed the same modular structure as the 515 variant, comprising 4 IgG-like fold domains, 3 of which contain internal Lys-Asn isopeptide with relatively conserved surroundings. Moreover, even though the main protein structure organization is conserved (RMSD=0.9 Å), in the H36B variant model structure there are two insertion loops which are not present in RrgB crystal structure. The first one spans residues 200 to 214, while the second one spans residues 402 to 410 (FIG. 5A). The function of these two additional loop regions is still unknown.

Based on the information obtained from structural analysis, we generated deletion mutants of the H36B variant, dividing this variant in four overlapping fragments, expressed in E. coli and purified as recombinant proteins. D1 corresponded to the region from amino acids 30 to 158, D2 to the region from amino acids 152 to 350, D3 to the region from amino acids 343 to 493 and D4 to the region from amino acids 487 to 658 (FIG. 5B). The purified soluble domains were used to immunize CD1 mice and sera raised against each fragments were tested in in vitro and in vivo protection assays.

As observed for the 515 variant, antisera raised against domain D3 showed the highest fluorescence shift when tested in Flow Cytometry Analysis on whole bacterial cells (FIG. 5C), and was able to promote efficient killing of bacteria when analyzed in an opsonophagocytosis assay in presence of human polymorphonuclear leukocytes (PMNs) and baby rabbit complement (FIG. 5D). In addition, domain D3 conferred significant levels of protection against the challenge strain in which the H36B variant was well expressed and exposed on the bacterial surface (Tables 5 and 6).

Domain D3 has further been confirmed as the immunodominant epitope for BP-2a in all the known allelic variants (data not shown). For example, as shown in Table 7, domain D3 from the CJB111 variant confers significant levels of protection against challenge with the CJB111 strain. In addition, two monoclonal antibodies (17C4/A3 and 4H11/B7, SEQ ID NOs: 262-269) have been found to bind an epitope comprising amino acids 411-436 (SEQ ID NO: 270) within the D3 sub-fragment from the 515 clade (SEQ ID NO: 38, fragment of SEQ ID NO: 2) (data not shown).

Fusion Proteins Carrying Protective Epitopes Confer Cross-Protection Against GBS Strains Expressing Different Alleles.

The mapping of the D3 domains as the immunodominant and protective region of the different variants was then used to facilitate the design of chimeric proteins to test in the animal model in order to evaluate the ability of these fusion proteins to confer broad-spectrum protection.

Figure 6A:
FIG. 6A(ii) and FIG. 6A(iii), multiple alignment of amino acid sequences corresponding to domains D3 plus 2 helices of domains D4 harbouring to allelic variant of BP-2a (D3and2H_515, SEQ ID NO:55; D3and2H_CJB111, SEQ ID NO:59); D3and2H_DK21, SEQ ID NO:71; D3and2H_090, SEQ ID NO:67; D3and2H_H36B, SEQ ID N0:63; and D3and2H_2603, SEQ ID NO:51).

Two fusion proteins were generated. The first one, fusion protein 6XD3, is composed of domain D3 of six backbone protein variants (515, CJB111, H36B, DK21, 090 and 2603) (FIGS. 6A and B). The second one, fusion protein 4XD3Helix, is composed of domain D3 plus the two protruding helices of domain D4 of the four most representative variants (515, CJB111, H36B and 2603) (FIGS. 6A and B). Each fusion protein has been cloned and expressed in E. coli and purified as recombinant proteins, as reported in Material and Methods (FIG. 6C).

Figure 6E:
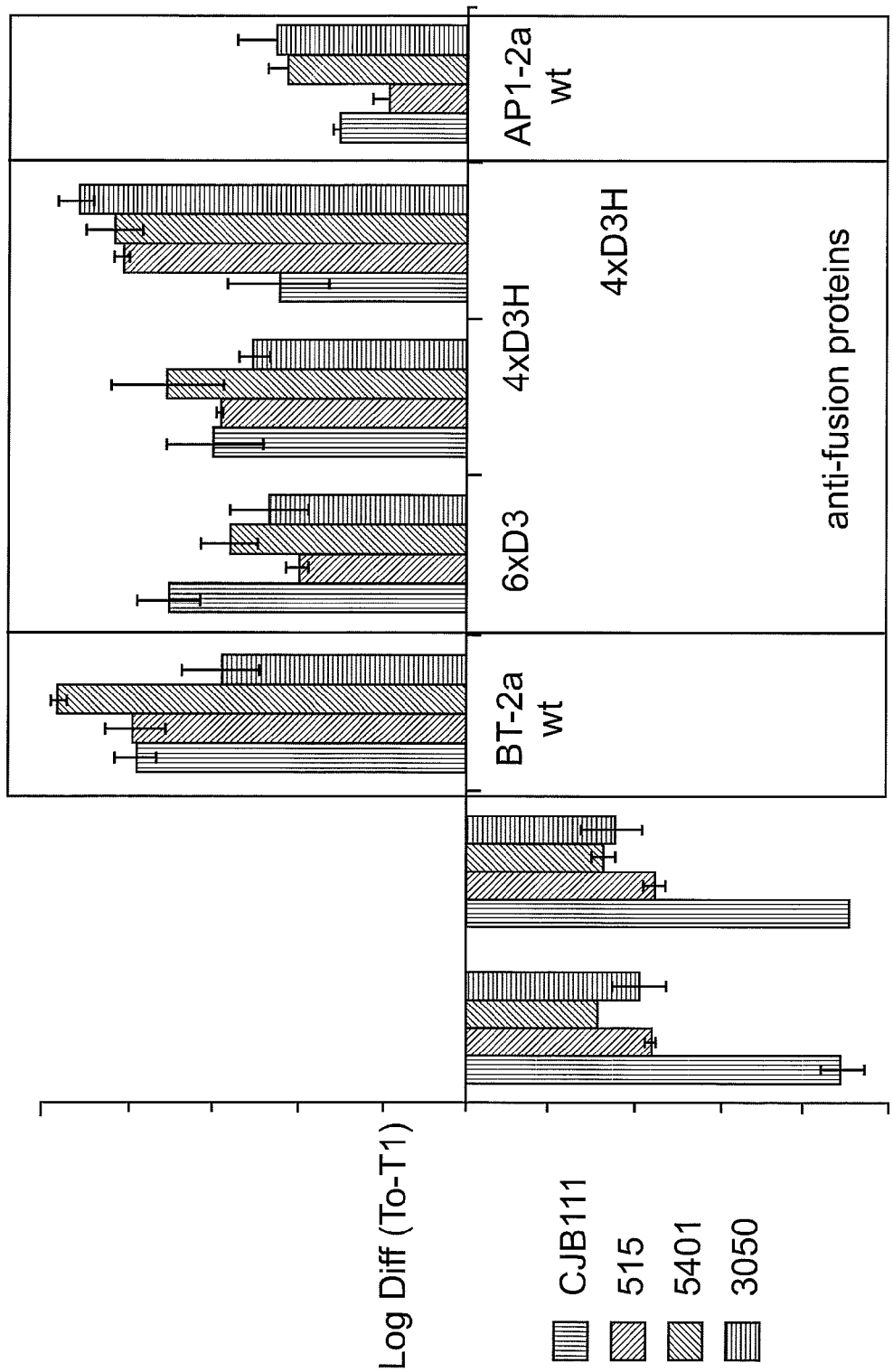
FIG. 6E, Opsonophagocytosis assay with mouse antisera raised against fusion proteins 6xD3 and 4xD3H.

The purified fusion proteins were used to immunize CD1 mice and sera raised against each fusion protein were tested in in vitro and in vivo protection assays. In order to understand if the sera were able to recognize pilus-like structures containing the different variants of BP-2a, we performed Western Blotting and FACS analysis (data not shown and FIG. 6D). The results showed that the immune sera generated against the two fusion proteins are able to recognize the pilus-like structures from the total extracts. Opsonophagocytosis experiments confirmed that antisera against fusion proteins were able to mediate complement-dependent phagocytic killing of GBS strains expressing different allelic variants of BP-2a (FIG. 6E). In addition, data from the in vivo protection model show that both fusion proteins were able to elicit protective immunity in mice challenged with strains expressing the different variant of the protein and can thus be used as a broadly-protective vaccine against GBS infections (Tables 8 and 9). Finally, Table 9 shows that the protective effect of the 6XD3 fusion is maintained if a His tag is used.

Discussion

Many bacterial pathogens, including S. agalactiae (GBS), have evolved a wide range of mechanisms to escape the immune system of their hosts or to adapt to environmental variation, for instance, adopting the strategy of gene variability and/or differential gene expression. These strategies play a crucial role in the capacity of pathogens to trigger disease and also explain why it is so difficult to develop vaccines against these microorganisms. Advances in sequencing technology and bioinformatics have resulted in an exponential growth of genome sequence information and complete genomes of multiple isolates are now available for a large number of pathogens. Multigenome analysis has revealed unexpectedly high gene variation between strains of a single species, with implications for effective vaccine and drug-discovery programs. Species such as streptococci may have a relatively small genome, but the total number of dispensable genes in the population permits sufficient flexibility for the species to adapt to environmental challenge.

Pathogenicity islands, such as pilus islands discovered in GBS and in other Gram-positive pathogens in the recent years, belong to the class of genomic islands, which have been acquired by horizontal gene transfer and are a typical example of dispensable genome. Because they promote genetic variability, genomic islands play an important role in microbial evolution. The three pilus islands identified in GBS (named PI-1, PI-2a and PI-2b) encode high molecular weight structures whose subunits are potential protein vaccine candidates. However, since pilin antigens are not universally present, conserved and expressed on the bacterial surface of a large subpopulation of GBS, only a combination of more proteins would be suitable for a broad-spectrum vaccine.

The backbone protein of pilus 2a (BP-2a), is essential for pilus polymerization. Although BP-2a is able to confer protection in mice and to mediate opsonophagocytic killing of live GBS bacteria at a level comparable to killing observed with antibodies against capsular polysaccharide antigens, it has the highest level of gene variability among all pilin antigens. The existence of at least seven non-cross protective allelic variants of BP-2a blocks the possibility to use this antigen alone for a broad-spectrum vaccine, except by including all the identified alleles in the vaccine.

For an immunogenic multi-variant antigen such as BP-2a, the selection of only a small protective portion of the protein (the highly surface-exposed IgG-like fold domain D3 of the protein) allowed us to rationally design and produce chimeric proteins by fusion of the single immunodominant domains from the different non-cross-reacting alleles. These chimeras acquired the capability to confer broad cross-protection in mice against infections from GBS strains expressing all BP-2a variants. The combined approach of structural and functional analysis reported herein, together to use of tools of genetic engineering allowed us generate fusion proteins containing the immunodominant domain of all main variants of BP-2a whilst conserving the native structural architecture of the selected domain. Interestingly, our results show that the ability of the domains to elicit protective immunity was not dependent on the present of internal isopeptide bonds.

The cross protective immune response of the fusion proteins is of fundamental importance in the development of a vaccine, since it decreases the risk of generating escape mutants and enables the generation of a protective immune response against genetically different GBS strains.

TABLE 1

Primers used in the experiments described herein

| Primers | Sequence (5'-3') | SEQ ID NO | Gene amplified |
|---|---|---|---|
| 515-D1 for | CACCATGGAAGAAGCAAAAACTACTGAC | 228 | fragment coding for the domain 1 (30-162aa) of BP-2a 515 variant |
| 515-D1 rev | TCATTAATCAGCCAAGATAGAACCATC | 229 | |
| 515-D2 for | CACCATGGATGGTTCTATCTTGGCTGAT | 230 | fragment coding for the domain 2 (158-338aa) of BP-2a 515 variant |
| 515-D2 rev | TCATTATTCAATTGTTGGGTTGTTGCC | 231 | |

TABLE 1-continued

Primers used in the experiments described herein

| Primers | Sequence (5'-3') | SEQ ID NO | Gene amplified |
|---|---|---|---|
| 515-D3 for | CACCATGGGCAACAACCCAACAATTGAA | 232 | fragment coding for the domain 3 (332-499aa) of BP-2a 515 variant |
| 515-D3 rev | TCATTAAGCTTTTTCTGCATCTGTTGC | 233 | |
| 515-D4 for | CACCATGTTGGCAGGAGCTACCTTCCTT | 234 | fragment coding for the domain 4 (472-640aa) of BP-2a 515 variant |
| 515-D4 rev | TCATTAAGTAACCTTCTTATTGATAAC | 235 | |
| H36B-D1 for | CACCATGGCTGAGATGGGAAATATCACT | 236 | fragment coding for the domain 1 (30-158aa) of BP-2a H36B variant |
| H36B-D1 rev | TCATTAGTCAGCAAGAACTTTGTCACC | 237 | |
| H36B-D2 for | CACCATGGGTGACAAAGTTCTTGCTGAC | 238 | fragment coding for the domain 2 (152-350aa) of BP-2a H36B variant |
| H36B-D2 rev | TCATTATACTTTTTTACCTGGTTTGTTACC | 239 | |
| H36B-D3 for | CTGTACTTCCAGGGCAACAAACCAGGTAAAAAAGTA | 240 | fragment coding for the domain 3 (343-493aa) of BP-2a H36B variant |
| H36B-D3 rev | AATTAAGTCGCGTTATTATGCACCTTGCAAGCGTTCTGT | 241 | |
| H36B-D4 for | CACCATGACAGAACGCTTGCAAGGTGCA | 242 | fragment coding for the domain 4 (487-658aa) of BP-2a H36B variant |
| H36B-D4 rev | TCATTAAGTCACTTTTTTGTTTTCTAT | 243 | |
| BP-2a-H36B for | GTTTGCGCATATGGCTGAGATGGGAAATATCACT | 244 | gene coding for the full length BP-2a H36B variant without the signal peptide and the LPXTG motif |
| BP-2a-H36B Rev | GTGGAATCTCGAGAGTCACTTTTTTGTTTTCTAT | 245 | |
| BP-2a 515 LPXTG-for | CTGTACTTCCAGGGCGAAGAAGCAAAAACTACTGACACAGTG | 246 | gene coding for the full length BP-2a 515 variant with LPXTG motif. |
| BP-2a 515 LPXTG-rev | AATTAAGTCGCGTTATGTACCAATACCACCTGTTTGTGGAAT | 247 | |
| 6XD3 FP-for | CTGTACTTCCAGGGCAATAATCCGACCATTGAAAATG | 248 | gene coding for the fusion protein 6XD3 |
| 6XD3 FP-rev | AATTAAGTCGCGTTAAATCGGCGTCGGATCGTTACTGTT | 249 | |
| LYS42ALA for | CACGCTATTGTCATGCCTCGAACTGCATTTGACGGTTTTACT | 250 | gene coding for the mutated form of BP-2a 515 variant containing K42A |
| LYS42ALA rev | CATGACAATAGCGTGCAAGGTCACTGTGTCAGTAGTTTTTGC | 251 | |
| LYS83ALA for | GAAGCGGCGGAAATCGCAGGTGCTTACTTTGCTTTC | 252 | gene coding for the mutated form of BP-2a 515 variant containing K83A |
| LYS83ALA rev | GATTTCCGCCGCTTCGCCTGAGCCAAAGTAAGTTTTAAG | 253 | |
| CJB111-D1 for | CACCATGGACGACGCAACAACTGATACT | 254 | fragment coding for domain 1 (30-162aa) of BP-2a CJB111 |

TABLE 1-continued

Primers used in the experiments described herein

| Primers | Sequence (5'-3') | SEQ ID NO | Gene amplified |
|---|---|---|---|
| CJB111-D1 rev | TCATTATGAATCAGCCAAGATAGAACCGTT | 255 | variant |
| CJB111-D2 for | CACCATGAACGGTTCTATCTTGGCTGATTCA | 256 | fragment coding for domain 2 (155-337aa) of BP-2a CJB111 variant |
| CJB111-D2 rev | TCATTATTCTTCCGTTGGGTTATTACC | 257 | variant |
| CJB111-D3 for | CACCATGGGTAATAACCCAACGGAAGAA | 258 | fragment coding for domain 3 (331-474aa) of BP-2a CJB111 variant |
| CJB111-D3 rev | TCATTAAGCTCCTGCCAAGCGTTCAGT | 259 | variant |
| CJB111-D4 for | CACCATGACTGAACGCTTGGCAGGAGCT | 260 | fragment coding for domain 4 (468-639aa) of BP-2a CJB111 variant |
| CJB111-D4 rev | TCATTAGGTTACTTTTTTGTTTTGAACTTG | 261 | variant |

TABLE 2

Data collection and refinement statistics of BP-2a-515 (molecular replacement). One crystal was used to solve the structure. Values in parentheses are for the highest resolution shell.

| | BP-2a-515 (residues 190-640) |
|---|---|
| Data collection | |
| Space group | $P2_12_12_1$ |
| Cell dimensions | |
| a, b, c (Å) | 63.7, 104.7, 159.3 |
| $\alpha = \beta = \gamma$ (°) | 90 |
| Resolution (Å) | 40-1.75 (1.75-1.84) |
| $R_{merge}$ | 0.099 (0.6) |
| I/σI | 14.9 (3.7) |
| Completeness (%) | 100 (100) |
| Redundancy | 9.6 (9.7) |
| Refinement | |
| Resolution (Å) | 40-1.75 |
| No. reflections | 103, 7178 |
| $R_{work}/R_{free}$ | 18.5/21.6 |
| No. atoms | |
| Protein | 7076 |
| Potassium ion | 3 |
| Water | 895 |
| B-factors | |
| Protein | 32.3 |
| Potassium ion | 24.8 |
| Water | 20.2 |
| R.m.s. deviations | |
| Bond lengths (Å) | 0.007 |
| Bond angles (°) | 1.047 |

TABLE 3

Results of an active maternal mouse immunization/neonatal pup challenge model to determine protection conferred by single domain of GBS59 515 variant against group B streptococcus 515 strain. Protection conferred by single domains of BP-2a 515 variant against GBS 515 strain assessed by active maternal mouse immunization/neonatal pup challenge model. Protection values was calculated as [(% dead in control − % dead in vaccine)/% dead in control]*100.

| Antigen | Alive/Treated | Protection (%) | Statistical significance (p value) |
|---|---|---|---|
| D1-515 | 17/59 | 20 | 0.0235 |
| D2-515 | 6/25 | 15 | 0.1310 |
| D3-515 | 19/28 | 64 | p < .0001 |
| D4-515 | 38/60 | 58 | p < .0001 |
| BP-2a-515 full length | 42/60 | 66 | p < .0001 |
| BP-2a-515 ΔIB | 28/38 | 71 | p < .0001 |
| PBS | 4/39 | | |

TABLE 4

Protection conferred by single domains of BP-2a-515 allele against GBS strain 515, assessed by active maternal mouse immunization/neonatal pup challenge model. Protection values were calculated as [(% sepsis in control − % sepsis in vaccine)/% sepsis in control]*100.

| Antigen | Protected/Treated | Protection (%) | Statistical significance (p value)* |
|---|---|---|---|
| D1-515 | 19/59 | 24 | 0.0098 |
| D2-515 | 7/25 | 20 | 0.0687 |
| D3-515 | 21/28 | 72 | p < .0001 |
| D4-515 | 42/60 | 67 | p < .0001 |
| full length BP-2a-515 | 44/60 | 70 | p < .0001 |
| PBS | 4/39 | | |

NOTE.
Groups of female mice received 3 doses (on days 1, 21, and 35) of either 20 μg antigen or buffer (PBS) combined with Freund's adjuvant. Mice were then mated, and their offspring were challenged with a GBS dose calculated to induce sepsis in 90% of the pups.
*p value, by Fisher's exact test.

TABLE 5

Protection conferred by single domains of BP-2a H36B variant against GBS 515 strain assessed by active maternal mouse immunization/neonatal pup challenge model. Protection values was calculated as [(% dead in control − % dead in vaccine)/% dead in control]*100.

| Antigen | Alive/Treated | Protection (%) | Statistical significance (p value) |
|---|---|---|---|
| D1-H36B | 49/60 | 9 | 0.1562 |
| D2-H36B | 31/48 | 28 | 0.0016 |
| D3-H36B | 2/40 | 94 | p < .0001 |
| D4-H36B | 19/37 | 43 | p < .0001 |
| BP-2a-H36B full length | 10/47 | 77 | p < .0001 |
| PBS | 53/59 | | |

TABLE 6

Neonatal protection conferred by single domains of BP-2a-H36B against GBS strain 5401, expressing the H36B BP-2a variant, assessed by active maternal mouse immunization/neonatal pup challenge model. Protection values were calculated as [(% sepsis in control − % sepsis in vaccine)/% sepsis in control]*100.

| Antigen | Protected/Treated | Protection (%) | Statistical significance (p value)* |
|---|---|---|---|
| D1-H36B | 15/60 | 1 | 0.52 |
| D2-H36B | 22/48 | 29 | 0.019 |
| D3-H36B | 38/40 | 93 | p < .0001 |
| D4-H36B | 20/37 | 39 | 0.0025 |
| full length BP-2a-H36B | 39/47 | 78 | p < .0001 |
| PBS | 14/59 | | |

NOTE.
Groups of female mice received 3 doses (on days 1, 21, and 35) of either 20 μg antigen or buffer (PBS) combined with Freund's adjuvant. Mice were then mated, and their offspring were challenged with a GBS dose calculated to induce sepsis in 90% of the pups.
*p value, by Fisher's exact test.

TABLE 7

Protection conferred by single domains of BP-2a-CJB111 variant against GBS CJB111 strain, expressing the BP-2a CJB111 variant, assessed by active maternal mouse immunization/neonatal pup challenge model. Protection values was calculated as [(% sepsis in control − % sepsis in vaccine)/% sepsis in control]*100.

| Antigen | Protected/Treated | Protection (%) | Statistical significance (p value)* |
|---|---|---|---|
| D1-CJB111 | 2/39 | 0 | 0.3619 |
| D2-CJB111 | 12/50 | 16 | 0.065 |
| D3-CJB111 | 41/54 | 73 | p < .0001 |
| D4-CJB111 | 13/46 | 20 | 0.0269 |
| full length BP-2a-CJB111 | 19/40 | 42 | p = 0.00015 |
| PBS | 4/41 | | |

NOTE.
Groups of female mice received 3 doses (on days 1, 21, and 35) of either 20 μg antigen or buffer (PBS) combined with Freund's adjuvant. Mice were then mated, and their offspring were challenged with a GBS dose calculated to induce sepsis in 90% of the pups.
*p value, by Fisher's exact test.

TABLE 8

Protection by active maternal mouse immunization/neonatal pup challenge model conferred by fusion proteins against a panel of GBS strains expressing different BP-2a allelic variants. Protection values was calculated as [(% dead in control − % dead in vaccine)/% dead in control]*100.

| GBS challenge strains | BP-2a allele | Protection (%) Fusion Protein 6XD3 | Fusion Protein 4XD3Helix (I) | Fusion Protein 4XD3Helix (II) |
|---|---|---|---|---|
| 515 | 515 | 63 | 43 | 62 |
| CJB111 | CJB111 | 70 | 52 | 36 |
| 3050 | 2603 | 68 | 100 | 79 |
| 5401 | H36B | 65 | 90 | 60 |

TABLE 9

Protection by active maternal mouse immunization/neonatal pup challenge model conferred by fusion protein 6xD3 against a panel of GBS strains expressing different BP-2a allelic variants. Protection values were calculated as [(% sepsis in control − % sepsis in vaccine)/% sepsis in control]*100.

| GBS challenge strain | BP-2a allele | antigen 6xD3 (protected/treated) | PBS (protected/treated) | Protection (%) |
|---|---|---|---|---|
| 515 | 515 | 50/68 | 13/50 | 65* |
| CJB111 | CJB111 | 38/48 | 7/30 | 73* |
| 3050 | 2603 | 53/70 | 12/40 | 66* |
| 5401 | H36B | 22/30 | 11/40 | 63* |
| DK21 | DK21 | 29/38 | 6/29 | 70* |
| CDC89 | CJB110 | 26/40 | 6/26 | 55* |

NOTE.
Groups of female mice received 3 doses (on days 1, 21, and 35) of either 20 μg antigen or buffer (PBS) combined with Freund's adjuvant. Mice were then mated, and their offspring were challenged with a GBS dose calculated to induce sepsis in 90% of the pups.
*p value, p < .0001 by Fisher's exact test.

TABLE 10

Protection by active maternal mouse immunization/neonatal pup challenge model conferred by fusion proteins with and without tags against a panel of GBS strains.

| GBS challenge strain | Fusion protein 6xD3 - His tag (protected/treated) | % survival | Fusion protein 6xD3 - native (protected/treated) | % survival | PBS (protected/treated) | % survival |
|---|---|---|---|---|---|---|
| 515 | 59/104 | 57 | 43/69 | 62 | 16/83 | 19 |
| 5401 | 37/58 | 64 | 53/64 | 83 | 2/50 | 4 |
| CJB111 | 33/80 | 41 | 36/70 | 51 | 9/54 | 17 |

LIST OF SEQUENCES

SEQ ID NO:1 (GBS59 2603)
SEQ ID NO:2 (GBS59 515)
SEQ ID NO:3 (GBS59 cjb111)
SEQ ID NO:4 (GBS59 h36b)
SEQ ID NO:5 (GBS59 CJB110)
SEQ ID NO:6 (GBS59 DK21)
SEQ ID NO:7 (GBS59 NEM316)
SEQ ID NO:8 (D1 2603)
SEQ ID NO:9 (D2 2603)
SEQ ID NO:10 (D3 2603)
SEQ ID NO:11 (D4 2603)
SEQ ID NO:12 (D1 515)
SEQ ID NO:13 (D2 515)
SEQ ID NO:14 (D3 515)

SEQ ID NO:15 (D4 515)
SEQ ID NO:16 (cjb111 D1)
SEQ ID NO:17 (cjb111 D2)
SEQ ID NO:18 (cjb111 D3)
SEQ ID NO:19 (cjb111 D4)
SEQ ID NO:20 (h36b D1)
SEQ ID NO:21 (h36b D2)
SEQ ID NO:22 (h36b D3)
SEQ ID NO:23 (h36b D4)
SEQ ID NO:24 (CJB110 D1)
SEQ ID NO:25 (CJB110 D2)
SEQ ID NO:26 (CJB110 D3)
SEQ ID NO:27 (CJB110 D4)
SEQ ID NO:28 (DK21 D1)
SEQ ID NO:29 (DK21 D2)
SEQ ID NO:30 (DK21 D3)
SEQ ID NO:31 (DK21 D4)
SEQ ID NO:32 (D1 NEM316)
SEQ ID NO:33 (D2 NEM316)
SEQ ID NO:34 (D3 NEM316)
SEQ ID NO:35 (D4 NEM316)
SEQ ID NO:36 (2603 D3 sub-fragment)
SEQ ID NO:37 (2603 D4H)
SEQ ID NO:38 (515 D3 sub-fragment)
SEQ ID NO:39 (515 D4H)
SEQ ID NO:40 (cjb111 D3 sub-fragment)
SEQ ID NO:41 (cjb111 D4H)
SEQ ID NO:42 (h36b D3 sub-fragment)
SEQ ID NO:43 (h36b D4H)
SEQ ID NO:44 (CJB110 D3 sub-fragment)
SEQ ID NO:45 (CJB110 D4H)
SEQ ID NO:46 (DK21 D3 sub-fragment)
SEQ ID NO:47 (DK21 D4H)
SEQ ID NO:48 (NEM316 D3 sub-fragment)
SEQ ID NO:49 (DK21 D4H)
SEQ ID NO:50 (2603 D3+D4)
SEQ ID NO:51 (2603 D3+D4H)
SEQ ID NO:52 (2603 D2+D3+D4)
SEQ ID NO:53 (2603 D2+D3+D4H)
SEQ ID NO:54 (515 D3+D4)
SEQ ID NO:55 (515 D3+D4H)
SEQ ID NO:56 (515 D2+D3+D4)
SEQ ID NO:57 (515 D2+D3+D4H)
SEQ ID NO:58 (cjb111 D3+D4)
SEQ ID NO:59 (cjb111 D3+D4H)
SEQ ID NO:60 (cjb111 D2+D3+D4)
SEQ ID NO:61 (cjb111 D2+D3+D4H)
SEQ ID NO:62 (h36b D3+D4)
SEQ ID NO:63 (h36b D3+D4H)
SEQ ID NO:64 (h36b D2+D3+D4)
SEQ ID NO:65 (h36b D2+D3+D4H)
SEQ ID NO:66 (CJB110 D3+D4)
SEQ ID NO:67 (CJB110 D3+D4H)
SEQ ID NO:68 (CJB110 D2+D3+D4)
SEQ ID NO:69 (CJB110 D2+D3+D4H)
SEQ ID NO:70 (DK21 D3+D4)
SEQ ID NO:71 (DK21 D3+D4H)
SEQ ID NO:72 (DK21 D2+D3+D4)
SEQ ID NO:73 (DK21 D2+D3+D4H)
SEQ ID NO:74 (NEM316 D3+D4)
SEQ ID NO:75 (NEM316 D3+D4H)
SEQ ID NO:76 (NEM316 D2+D3+D4)
SEQ ID NO:77 (NEM316 D2+D3+D4H)
SEQ ID NO:78 (515 short fragment of D3)
SEQ ID NO:79 (his tag)
SEQ ID NO:80 (linker)
SEQ ID NO:81 (linker)
SEQ ID NO:82 (linker)
SEQ ID NO:83 (Fusion E)
SEQ ID NO:84 (Fusion F)
SEQ ID NO:85 (Fusion G)
SEQ ID NO:86 (Fusion H)
SEQ ID NO:87 (Fusion I)
SEQ ID NO:88 (encoding Fusion E)
SEQ ID NO:89 (encoding Fusion F)
SEQ ID NO:90 (encoding Fusion G)
SEQ ID NO:91 (encoding Fusion H)
SEQ ID NO:92 (encoding Fusion I)
SEQ ID NO:93 (encoding Fusion E—*E. Coli* optimised)
SEQ ID NO:94 (encoding Fusion F—*E. Coli* optimised)
SEQ ID NO:95 (encoding Fusion G—*E. Coli* optimised)
SEQ ID NO:96 (encoding Fusion H—*E. Coli* optimised)
SEQ ID NO:97 (encoding Fusion I—*E. Coli* optimised)
SEQ ID NO:98 (IC adjuvant)
SEQ ID NO:99 (Polycationic peptide adjuvant)
SEQ ID NO:100 (encoding GBS59 2603)
SEQ ID NO:101 (encoding GBS59 515)
SEQ ID NO:102 (encoding GBS59 cjb111)
SEQ ID NO:103 (encoding GBS59 h36b)
SEQ ID NO:104 (encoding GBS59 CJB110)
SEQ ID NO:105 (encoding GBS59 DK21)
SEQ ID NO:106 (encoding GBS59 NEM316)
SEQ ID NO:107 (encoding 2603 D1)
SEQ ID NO:108 (encoding 2603 D2)
SEQ ID NO:109 (encoding 2603 D3)
SEQ ID NO:110 (encoding 2603 D4)
SEQ ID NO:111 (encoding 515 D1)
SEQ ID NO:112 (encoding 515 D2)
SEQ ID NO:113 (encoding 515 D3)
SEQ ID NO:114 (encoding 515 D4)
SEQ ID NO:115 (encoding cjb111 D1)
SEQ ID NO:116 (encoding cjb111 D2)
SEQ ID NO:117 (encoding cjb111 D3)
SEQ ID NO:118 (encoding cjb111 D4)
SEQ ID NO:119 (encoding h36b D1)
SEQ ID NO:120 (encoding h36b D2)
SEQ ID NO:121 (encoding h36b D3)
SEQ ID NO:122 (encoding h36b D4)
SEQ ID NO:123 (encoding CJB110 D1)
SEQ ID NO:124 (encoding CJB110 D2)
SEQ ID NO:125 (encoding CJB110 D3)
SEQ ID NO:126 (encoding CJB110 D4)
SEQ ID NO:127 (encoding DK21 D1)
SEQ ID NO:128 (encoding DK21 D2)
SEQ ID NO:129 (encoding DK21 D3)
SEQ ID NO:130 (encoding DK21 D4)
SEQ ID NO:131 (encoding NEM316 D1)
SEQ ID NO:132 (encoding NEM316 D2)
SEQ ID NO:133 (encoding NEM316 D3)
SEQ ID NO:134 (encoding NEM316 D4)
SEQ ID NO:135 (encoding 2603 D3 sub-fragment)
SEQ ID NO:136 (encoding 2603 D4H)
SEQ ID NO:137 (encoding 515 D3 sub-fragment)
SEQ ID NO:138 (encoding 515 D4H)
SEQ ID NO:139 (encoding cjb111 D3 sub-fragment)
SEQ ID NO:140 (encoding cjb111 D4H)
SEQ ID NO:141 (encoding h36b D3 sub-fragment)
SEQ ID NO:142 (encoding h36b D4H)
SEQ ID NO:143 (encoding CJB110 D3 sub-fragment)
SEQ ID NO:144 (encoding CJB110 D4H)
SEQ ID NO:145 (encoding DK21 D3 sub-fragment)
SEQ ID NO:146 (encoding DK21 D4H)
SEQ ID NO:147 (encoding NEM316 D3 sub-fragment)
SEQ ID NO:148 (encoding NEM316 D4H)

SEQ ID NO:149 (encoding 2603 D3+D4)
SEQ ID NO:150 (encoding 2603 D3+D4H)
SEQ ID NO:151 (encoding 2603 D2+D3+D4)
SEQ ID NO:152 (encoding 2603 D2+D3+D4H)
SEQ ID NO:153 (encoding 515 D3+D4)
SEQ ID NO:154 (encoding 515 D3+D4H)
SEQ ID NO:155 (encoding 515 D2+D3+D4)
SEQ ID NO:156 (encoding 515 D2+D3+D4H)
SEQ ID NO:157 (encoding cjb111 D3+D4)
SEQ ID NO:158 (encoding cjb111 D3+D4H)
SEQ ID NO:159 (encoding cjb111 D2+D3+D4)
SEQ ID NO:160 (encoding cjb111 D2+D3+D4H)
SEQ ID NO:161 (encoding h36b D3+D4)
SEQ ID NO:162 (encoding h36b D3+D4H)
SEQ ID NO:163 (encoding h36b D2+D3+D4)
SEQ ID NO:164 (encoding h36b D2+D3+D4H)
SEQ ID NO:165 (encoding CJB110 D3+D4)
SEQ ID NO:166 (encoding CJB110 D3+D4H)
SEQ ID NO:167 (encoding CJB110 D2+D3+D4)
SEQ ID NO:168 (encoding CJB110 D2+D3+D4H)
SEQ ID NO:169 (encoding DK21 D3+D4)
SEQ ID NO:170 (encoding DK21 D3+D4H)
SEQ ID NO:171 (encoding DK21 D2+D3+D4)
SEQ ID NO:172 (encoding DK21 D2+D3+D4H)
SEQ ID NO:173 (encoding NEM316 D3+D4)
SEQ ID NO:174 (encoding NEM D3+D4H)
SEQ ID NO:175 (encoding NEM316 D2+D3+D4)
SEQ ID NO:176 (encoding NEM316 D2+D3+D4H)
SEQ ID NO:177 (GBS80 2603)
SEQ ID NO:178 (GBS80 2603 without leader)
SEQ ID NO:179 (GBS80 2603 without transmembrane/cytoplasmic region)
SEQ ID NO:180 (GBS80 2603 without transmembrane/cytoplasmic region and cell wall anchor)
SEQ ID NO:181 (GBS80 2603 without extracellular domain)
SEQ ID NO:182 (N-terminal immunogenic fragment of GBS80 2603)
SEQ ID NO:183 (GBS67 2603)
SEQ ID NO:184 (GBS67 2603 without transmembrane region)
SEQ ID NO:185 (GBS67 2603 without transmembrane and cell wall anchor motif)
SEQ ID NO:186 (N-terminal fragment of GBS67 2603)
SEQ ID NO:187 (N-terminal fragment of GBS67 2603)
SEQ ID NO:188 (GBS67 h36b)
SEQ ID NO:189 (N-terminal fragment of GBS67 h36b)
SEQ ID NO:190 (N-terminal fragment of GBS67 h36b)
SEQ ID NO:191 (GBS67 CJB111)
SEQ ID NO:192 (N-terminal fragment of GBS67 CJB111)
SEQ ID NO:193 (N-terminal fragment of GBS67 CJB111)
SEQ ID NO:194 (GBS67 515)
SEQ ID NO:195 (N-terminal fragment of GBS67 515)
SEQ ID NO:196 (N-terminal fragment of GBS67 515)
SEQ ID NO:197 (GBS67 NEM316)
SEQ ID NO:198 (N-terminal fragment of GBS67 NEM316)
SEQ ID NO:199 (N-terminal fragment of GBS67 NEM316)
SEQ ID NO:200 (GBS67 DK21)
SEQ ID NO:201 (N-terminal fragment of GBS67 DK21)
SEQ ID NO:202 (N-terminal fragment of GBS67 DK21)
SEQ ID NO:203 (GBS67 CJB110)
SEQ ID NO:204 (N-terminal fragment of GBS67 CJB110)
SEQ ID NO:205 (N-terminal fragment of GBS67 CJB110)
SEQ ID NO:206 (GBS1523 COH1)
SEQ ID NO:207 (GBS1523 COH1 without signal sequence region)
SEQ ID NO:208 (GBS1523 COH1 with mutation at position 41)
SEQ ID NO:209 (GBS80-GBS1523 hybrid)
SEQ ID NO:210 (GBS80-GBS1523 hybrid)
SEQ ID NO:211 (GBS80-GBS1523 hybrid)
SEQ ID NO:212 (GBS80-GBS1523 hybrid)
SEQ ID NO:213 (GBS104 2603)
SEQ ID NO:214 (GBS1524)
SEQ ID NO:215 (GBS3 2603)
SEQ ID NO:216 (GBS3 2603 without signal sequence region)
SEQ ID NO:217 (GBS3 2603 coiled coil and proline-rich segments)
SEQ ID NO:218 (GBS3 2603 signal sequence and coiled coil)
SEQ ID NO:219 (GBS3 2603 coiled coil segment)
SEQ ID NO:220 (GBS3 2603 signal sequence, coiled coil and proline rich segment)
SEQ ID NO:221 (GBS3 515)
SEQ ID NO:222 (GBS3 cjb111)
SEQ ID NO:223 (GBS3 coh1)
SEQ ID NO:224 (SAN1485 coh1)
SEQ ID NO:225 (GBS147 2603)
SEQ ID NO:226 (GBS328 2603)
SEQ ID NO:227 (GBS84 2603)
SEQ ID NO:228-261 (Primers)
SEQ ID NO:262 (4H11/B7-VH DNA sequence)
SEQ ID NO:263 (4H11/B7-VH amino acid sequence)
SEQ ID NO:264 (4H11/B7-VLk DNA sequence)
SEQ ID NO:265 (4H11/B7-VLk amino acid sequence)
SEQ ID NO:266 (17C4/A3-VH DNA sequence)
SEQ ID NO:267 (17C4/A3-VH amino acid sequence)
SEQ ID NO:268 (17C4/A3-VLk DNA sequence)
SEQ ID NO:269 (17C4/A3-VLk amino acid sequence)
SEQ ID NO:270 (epitope of D3 bound by 4H11/B7 and 17C4/A3)
SEQ ID NO:271 (RrgB)

REFERENCES

[1] Rosini et al, *Molecular Microbiology*, 2006, 61(1): 126-141
[2] Margarit et al, *Journal of Infectious Diseases*, 2009, 199: 108-115
[3] Needleman & Wunsch (1970) *J. Mol. Biol.* 48, 443-453.
[4] Rice et al. (2000) *Trends Genet* 16:276-277.
[5] Bodanszky (1993) *Principles of Peptide Synthesis* (ISBN: 0387564314).
[6] Fields et al. (1997) *Meth Enzymol* 289: *Solid-Phase Peptide Synthesis*. ISBN: 0121821900.
[7] Chan & White (2000) *Fmoc Solid Phase Peptide Synthesis*. ISBN: 0199637245.
[8] Kullmann (1987) *Enzymatic Peptide Synthesis*. ISBN: 0849368413.
[9] Ibba (1996) *Biotechnol Genet Eng Rev* 13:197-216.
[10] U.S. Pat. No. 5,707,829
[11] *Vaccine Design . . .* (1995) eds. Powell & Newman. ISBN: 030644867X. Plenum.
[12] WO90/14837.
[13] WO90/14837.
[14] Podda & Del Giudice (2003) *Expert Rev Vaccines* 2:197-203.
[15] Podda (2001) *Vaccine* 19: 2673-2680.

[16] *Vaccine Design: The Subunit and Adjuvant Approach* (eds. Powell & Newman) Plenum Press 1995 (ISBN 0-306-44867-X).
[17] *Vaccine Adjuvants: Preparation Methods and Research Protocols* (Volume 42 of *Methods in Molecular Medicine* series). ISBN: 1-59259-083-7. Ed. O'Hagan.
[18] Allison & Byars (1992) *Res Immunol* 143:519-25.
[19] Hariharan et al. (1995) *Cancer Res* 55:3486-9.
[20] US-2007/014805.
[21] WO95/11700.
[22] U.S. Pat. No. 6,080,725.
[23] WO2006/113373.
[24] WO2005/097181.
[25] U.S. Pat. No. 5,057,540.
[26] WO96/33739.
[27] EP-A-0109942.
[28] WO96/11711.
[29] WO00/07621.
[30] Barr et al. (1998) *Advanced Drug Delivery Reviews* 32:247-271.
[31] Sjolanderet et al. (1998) *Advanced Drug Delivery Reviews* 32:321-338.
[32] Niikura et al. (2002) *Virology* 293:273-280.
[33] Lenz et al. (2001) *J Immunol* 166:5346-5355.
[34] Pinto et al. (2003) *J Infect Dis* 188:327-338.
[35] Gerber et al. (2001) *J Virol* 75:4752-4760.
[36] WO03/024480.
[37] WO03/024481.
[38] Gluck et al. (2002) *Vaccine* 20:B10-B16.
[39] EP-A-0689454.
[40] Johnson et al. (1999) *Bioorg Med Chem Lett* 9:2273-2278.
[41] Evans et al. (2003) *Expert Rev Vaccines* 2:219-229.
[42] Meraldi et al. (2003) *Vaccine* 21:2485-2491.
[43] Pajak et al. (2003) *Vaccine* 21:836-842.
[44] Kandimalla et al. (2003) *Nucleic Acids Research* 31:2393-2400.
[45] WO02/26757.
[46] WO99/62923.
[47] Krieg (2003) *Nature Medicine* 9:831-835.
[48] McCluskie et al. (2002) *FEMS Immunology and Medical Microbiology* 32:179-185.
[49] WO98/40100.
[50] U.S. Pat. No. 6,207,646.
[51] U.S. Pat. No. 6,239,116.
[52] U.S. Pat. No. 6,429,199.
[53] Kandimalla et al. (2003) *Biochemical Society Transactions* 31 (part 3):654-658.
[54] Blackwell et al. (2003) *J Immunol* 170:4061-4068.
[55] Krieg (2002) *Trends Immunol* 23:64-65.
[56] WO01/95935.
[57] Kandimalla et al. (2003) *BBRC* 306:948-953.
[58] Bhagat et al. (2003) *BBRC* 300:853-861.
[59] WO03/035836.
[60] Schellack et al. (2006) *Vaccine* 24:5461-72.
[61] WO95/17211.
[62] WO98/42375.
[63] Beignon et al. (2002) *Infect Immun* 70:3012-3019.
[64] Pizza et al. (2001) *Vaccine* 19:2534-2541.
[65] Pizza et al. (2000) *Int J Med Microbiol* 290:455-461.
[66] Scharton-Kersten et al. (2000) *Infect Immun* 68:5306-5313.
[67] Ryan et al. (1999) *Infect Immun* 67:6270-6280.
[68] Partidos et al. (1999) *Immunol Lett* 67:209-216.
[69] Peppoloni et al. (2003) *Expert Rev Vaccines* 2:285-293.
[70] Pine et al. (2002) *J Control Release* 85:263-270.
[71] Tebbey et al. (2000) *Vaccine* 18:2723-34.
[72] Domenighini et al. (1995) *Mol Microbiol* 15:1165-1167.
[73] WO99/40936.
[74] WO99/44636.
[75] Singh et al] (2001) *J Cont Release* 70:267-276.
[76] WO99/27960.
[77] U.S. Pat. No. 6,090,406.
[78] U.S. Pat. No. 5,916,588.
[79] EP-A-0626169.
[80] WO99/52549.
[81] WO01/21207.
[82] WO01/21152.
[83] Andrianov et al. (1998) *Biomaterials* 19:109-115.
[84] Payne et al. (1998) *Adv Drug Delivery Review* 31:185-196.
[85] Stanley (2002) *Clin Exp Dermatol* 27:571-577.
[86] Jones (2003) *Curr Opin Investig Drugs* 4:214-218.
[87] WO99/11241.
[88] WO94/00153.
[89] WO98/57659.
[90] European patent applications 0835318, 0735898 and 0761231.
[91] Donnelly et al. (1997) *Annu Rev Immunol* 15:617-648.
[92] Strugnell et al. (1997) *Immunol Cell Biol* 75(4):364-369.
[93] Cui (2005) *Adv Genet* 54:257-89.
[94] Robinson & Torres (1997) *Seminars in Immunol* 9:271-283.
[95] Brunham et al. (2000) *J Infect Dis* 181 Suppl 3:S538-43.
[96] Svanholm et al. (2000) *Scand J Immunol* 51(4):345-53.
[97] *DNA Vaccination—Genetic Vaccination* (1998) eds. Koprowski et al. (ISBN 3540633928).
[98] *Gene Vaccination: Theory and Practice* (1998) ed. Raz (ISBN 3540644288).
[99] Findeis et al., *Trends Biotechnol.* (1993) 11:202
[100] Chiou et al. (1994) *Gene Therapeutics: Methods And Applications Of Direct Gene Transfer*. ed. Wolff
[101] Wu et al., *J. Biol. Chem.* (1988) 263:621
[102] Wu et al., *J. Biol. Chem.* (1994) 269:542
[103] Zenke et al., *Proc. Natl. Acad. Sci. (USA)* (1990) 87:3655
[104] Wu et al., *J. Biol. Chem.* (1991) 266:338
[105] Jolly, *Cancer Gene Therapy* (1994) 1:51
[106] Kimura, *Human Gene Therapy* (1994) 5:845
[107] Connelly, *Human Gene Therapy* (1995) 1:185
[108] Kaplitt, *Nature Genetics* (1994) 6:148
[109] WO 90/07936.
[110] WO 94/03622.
[111] WO 93/25698.
[112] WO 93/25234.
[113] U.S. Pat. No. 5,219,740.
[114] WO 93/11230.
[115] WO 93/10218.
[116] U.S. Pat. No. 4,777,127.
[117] GB Patent No. 2,200,651.
[118] EP-A-0345242.
[119] WO 91/02805.
[120] WO 94/12649.
[121] WO 93/03769.
[122] WO 93/19191.
[123] WO 94/28938.
[124] WO 95/11984.
[125] WO 95/00655.
[126] Curiel, *Hum. Gene Ther.* (1992) 3:147
[127] Wu, *J. Biol. Chem.* (1989) 264:16985
[128] U.S. Pat. No. 5,814,482.
[129] WO 95/07994.
[130] WO 96/17072.
[131] WO 95/30763.

[132] WO 97/42338.
[133] WO 90/11092.
[134] U.S. Pat. No. 5,580,859
[135] U.S. Pat. No. 5,422,120
[136] WO 95/13796.
[137] WO 94/23697.
[138] WO 91/14445.
[139] EP-0524968.
[140] Philip, *Mol. Cell Biol.* (1994) 14:2411
[141] Woffendin, *Proc. Natl. Acad. Sci.* (1994) 91:11581
[142] U.S. Pat. No. 5,206,152.
[143] WO 92/11033.
[144] U.S. Pat. No. 5,149,655.
[145] Zwijnenburg et al. (2001) *J Infect Dis* 183:1143-6.
[146] WO2009/016515.
[147] Tettelin et al, Proc. Natl. Acad. Sci. U.S.A. 99 (19), 12391-12396 (2002)
[148] Tettelin et al, Proc. Natl. Acad. Sci. U.S.A. 102 (39), 13950-13955 (2005)
[149] WO09/101403
[150] WO2006/130328
[151] Lewis et al. (2004) *PNAS USA* 101:11123-8.
[152] WO2006/050341.
[153] Paoletti et al. (1992) *J Clin Invest* 89:203-9
[154] WO96/40795
[155] Wessels et al. (1989) *Infect Immun* 57:1089-94.
[156] WO2006/082527.
[157] Paoletti et al. (1990) *J Biol Chem* 265:18278-83.
[158] Wessels et al. (1990) *J Clin Invest* 86:1428-33.
[159] Paoletti et al. (1992) *Infect Immun* 60:4009-14.
[160] Wessels et al. (1987) *Proc Natl Acad Sci USA* 84:9170-4.
[161] Wang et al. (2003) *Vaccine* 21:1112-7.
[162] Wessels et al. (1993) *Infect Immun* 61:4760-6
[163] Wessels et al. (1995) *Infect Dis* 171:879-84.
[164] Baker et al. (2004) *Infect Dis* 189:1103-12.
[165] U.S. Pat. No. 4,356,170.
[166] Paoletti & Kasper (2003) *Expert Opin Biol Ther* 3:975-84.
[167] WO2005/000346
[168] Anonymous (January 2002) *Research Disclosure*, 453077.
[169] Anderson (1983) *Infect Immun* 39(1):233-238.
[170] Anderson et al. (1985) *J Clin Invest* 76(1):52-59.
[171] EP-A-0372501.
[172] EP-A-0378881.
[173] EP-A-0427347.
[174] WO93/17712.
[175] WO94/03208.
[176] WO98/58668.
[177] EP-A-0471177.
[178] WO91/01146.
[179] Falugi et al. (2001) *Eur J Immunol* 31:3816-3824.
[180] Baraldo et al. (2004) *Infect Immun* 72(8):4884-7.
[181] EP-A-0594610.
[182] Ruan et al. (1990) *J Immunol* 145:3379-3384.
[183] WO00/56360.
[184] WO01/72337.
[185] WO00/61761.
[186] WO00/33882
[187] WO99/42130.
[188] U.S. Pat. No. 4,761,283.
[189] U.S. Pat. No. 4,356,170.
[190] U.S. Pat. No. 4,882,317.
[191] U.S. Pat. No. 4,695,624.
[192] *Mol. Immunol.*, 1985, 22, 907-919
[193] EP-A-0208375.
[194] Bethell G. S. et al., *J. Biol. Chem.*, 1979, 254, 2572-4
[195] Hearn M. T. W., *J. Chromatogr.*, 1981, 218, 509-18
[196] WO00/10599.
[197] Gever et al., Med. Microbiol. Immunol, 165: 171-288 (1979).
[198] U.S. Pat. No. 4,057,685.
[199] U.S. Pat. Nos. 4,673,574; 4,761,283; 4,808,700.
[200] U.S. Pat. No. 4,459,286.
[201] U.S. Pat. No. 4,965,338.
[202] U.S. Pat. No. 4,663,160.
[203] WO2007/000343.
[204] *Vaccines*. (eds. Plotkin & Orenstein). 4th edition, 2004, ISBN: 0-7216-9688-0.
[205] Rappuoli et al. (1991) *TIBTECH* 9:232-238.
[206] Harper et al. (2004) *Lancet* 364(9447):1757-65.
[207] Brandt et al. (2006) *J Antimicrob Chemother.* 58(6): 1291-4. Epub 2006 Oct. 26
[208] Winter et al., (1991) *Nature* 349:293-99
[209] U.S. Pat. No. 4,816,567.
[210] Inbar et al., (1972) *Proc. Natl. Acad. Sci. U.S.A.* 69:2659-62.
[211] Ehrlich et al., (1980) *Biochem* 19:4091-96.
[212] Huston et al., (1988) Proc. Natl. Acad. Sci. U.S.A. 85:5897-83.
[213] Pack et al., (1992) *Biochem* 31, 1579-84.
[214] Cumber et al., (1992) *J. Immunology* 149B, 120-26.
[215] Riechmann et al., (1988) *Nature* 332, 323-27.
[216] Verhoeyan et al., (1988) *Science* 239, 1534-36.
[217] GB 2,276,169.
[218] Gennaro (2000) *Remington: The Science and Practice of Pharmacy*. 20th edition, ISBN: 0683306472.
[219] *Methods In Enzymology* (S. Colowick and N. Kaplan, eds., Academic Press, Inc.)
[220] *Handbook of Experimental Immunology*, Vols. I-IV (D. M. Weir and C. C. Blackwell, eds, 1986, Blackwell Scientific Publications)
[221] Sambrook et al. (2001) *Molecular Cloning: A Laboratory Manual*, 3rd edition (Cold Spring Harbor Laboratory Press).
[222] *Handbook of Surface and Colloidal Chemistry* (Birdi, K. S. ed., CRC Press, 1997)
[223] Ausubel et al. (eds) (2002) *Short protocols in molecular biology*, 5th edition (Current Protocols).
[224] *Molecular Biology Techniques: An Intensive Laboratory Course*, (Ream et al., eds., 1998, Academic Press)
[225] PCR (*Introduction to Biotechniques Series*), 2nd ed. (Newton & Graham eds., 1997, Springer Verlag)
[226] Geysen et al. (1984) *PNAS USA* 81:3998-4002.
[227] Carter (1994) *Methods Mol Biol* 36:207-23.
[228] Jameson, B A et al. 1988, *CABIOS* 4(1):181-186.
[229] Raddrizzani & Hammer (2000) *Brief Bioinform* 1(2): 179-89.
[230] Bublil et al. (2007) *Proteins* 68(1):294-304.
[231] De Lalla et al. (1999) *J. Immunol.* 163:1725-29.
[232] Kwok et al. (2001) *Trends Immunol* 22:583-88.
[233] Brusic et al. (1998) *Bioinformatics* 14(2):121-30
[234] Meister et al. (1995) *Vaccine* 13(6):581-91.
[235] Roberts et al. (1996) *AIDS Res Hum Retroviruses* 12(7): 593-610.
[236] Maksyutov & Zagrebelnaya (1993) *Comput Appl Biosci* 9(3):291-7.
[237] Feller & de la Cruz (1991) *Nature* 349(6311):720-1.
[238] Hopp (1993) *Peptide Research* 6:183-190.
[239] Welling et al. (1985) *FEBS Lett.* 188:215-218.
[240] Davenport et al. (1995) *Immunogenetics* 42:392-297.
[241] Tsurui & Takahashi (2007) *J Pharmacol Sci.* 105(4): 299-316.

[242] Tong et al. (2007) *Brief Bioinform.* 8(2):96-108.
[243] Schirle et al. (2001) *J Immunol Methods.* 257(1-2): 1-16.
[244] Chen et al. (2007) *Amino Acids* 33(3):423-8.
[245] *Current Protocols in Molecular Biology* (F. M. Ausubel et al., eds., 1987) Supplement 30
[246] Smith & Waterman (1981) *Adv. Appl. Math.* 2: 482-489.
[247] Altschul (1997) Nucleic Acids Res. 1997 Sep. 1; 25(17):3389-402.
[248] Proteins. 1995 November; 23(3):318-26.
[249] Klock et al, (2008), *Proteins,* 71:982-994
[250] Maione et al (2005), *Science,* 309: 148-150
[251] Krissinel E., and Hendrick, K. (2007): J. Mol. Biol. 372: 774-797
[252] Spraggon G. et al (2010) *PLoS One* 5, e10919

SEQUENCE LISTING (273 sequences)

SEQ ID NO: 1 - protein, 705 aa, Streptococcus agalactiae
MKRINKYFAMFSALLLTLTSLLSVAPAFADEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVTIPQTGGIGTILFTIIGLSIMLGAVVIMKRRQSKEA

SEQ ID NO: 2 - protein, 675 aa, Streptococcus agalactiae
MKKINKYFAVFSALLLTVTSLFSVAPVFAEEAKTTDTVTLHKIVMPRTAFDGFTAGTKGKDNTDYVGKQIEDLKTYFGSGEAKEIAGAYFAFKNEAGTKYITENGEEVDTLDTTDAKGCAVLKGLTTDNGFKFNTSKLTGTYQIVELKEKSTYNNDGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVTIPQTGGIGTIFFTIIGLSIMLGAVVIMKRRQSEEV

SEQ ID NO: 3 - protein, 674 aa, Streptococcus agalactiae
MKKINKCLTMFSTLLLILTSLFSVAPAFADDATTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDNGFVFNTAKLKGIYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVTIPQTGGIGTILFTIIGLSIMLGAVVIMKKRQSEEA

SEQ ID NO: 4 - protein, 693 aa, Streptococcus agalactiae
MKRINKYFAMFSALLLILTSLLSVAPVFAAEMGNITKTVTLHKIVQTSDNLAKPNFPGINGLNGTKYMGQKLTDISGYFGQGSKEIAGAFFAVMNESQTKYITESGTEVESIDAAGVLKGLTTENGITFNTANLKGTYQIVELLDKSNYKNGDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVTIPQTGGIGTILFTIIGLSIMLGAVIIMKRRQSEEA

SEQ ID NO: 5 - protein, 704 aa, Streptococcus agalactiae
MKKINKYFAVFSALLLTVTSLLSVAPAFADEATTNTVTLHKILQTESNLNKSNFPGTTGLNGDDYKGESISDLAEYFGSGSKEIDGAFFALALEEEKDGVVQYVKAKANDKLTPDLITKGTPATTTKVEEAVGGLTTGTGIVFNTAGLKGNFKIIELKDKSTYNNNGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVTIPQTGGIGTILFTIIGLSIMLGAVVIMKRRQSEEA

SEQ ID NO: 6 - protein, 682 aa, Streptococcus agalactiae
MKKINKFFVAFSALLLILTSLLSVAPAFAEEERTTETVTLHKILQTETNLKNSAFPGTKGLDGTEYDGKAIDKLDSYFGNDSKDIGGAYFILANSKGEYIKANDKNKLKPEFSGNTPKTTLNISEAVGGLTEENAGIKFETTGLRGDFQIIELKDKSTYNNGGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVTIPQTGGIGTILFTIIGLSIMLGAVVIMKRRQSEEA

SEQ ID NO: 7 - protein, 674 aa, Streptococcus agalactiae
MKKINKCLTVFSTLLLILTSLFSVAPAFADDVTTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDTGFAFNTAKLKGTYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVTIPQTGGIGTILFTIIGLSIMLGAVVVMKKRQSEEA

SEQ ID NO: 8 - protein, 146 aa, Streptococcus agalactiae
DEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAA

SEQ ID NO: 9 - protein, 201 aa, Streptococcus agalactiae
NGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKD

SEQ ID NO: 10 - protein, 147 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAG

SEQ ID NO: 11 - protein, 168 aa, Streptococcus agalactiae
QGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVT

SEQ ID NO: 12 - protein, 133 aa, Streptococcus agalactiae
EEAKTTDTVTLHKIVMPRTAFDGFTAGTKGKDNTDYVGKQIEDLKTYFGSGEAKEIAGAYFAFKNEAGTKYITENGEEVDTLDTTDAKGCAVLKGLTTDNGFKFNTSKLTGTYQIVELKEKSTYNNDGSILAD

SEQ ID NO: 13 - protein, 183 aa, Streptococcus agalactiae
DGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIE

SEQ ID NO: 14 - protein, 168 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKA

SEQ ID NO: 15 - protein, 169 aa, Streptococcus agalactiae
LAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVT

SEQ ID NO: 16 - protein, 133 aa, Streptococcus agalactiae
DDATTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDNGFVFNTAKLKGIYQIVELKEKSNYDNNGSILADS

SEQ ID NO: 17 - protein, 183 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEE

SEQ ID NO: 18 - protein, 144 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGA

SEQ ID NO: 19 - protein, 172 aa, Streptococcus agalactiae
TERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVT

SEQ ID NO: 20 - protein, 129 aa, Streptococcus agalactiae
AEMGNITKTVTLHKIVQTSDNLAKPNFPGINGLNGTKYMGQKLTDISGYFGQGSKEIAGAFFAVMNESQTKYITESGTEVESIDAAGVLKGLTTENGITFNTANLKGTYQIVELLDKSNYKNGDKVLAD

SEQ ID NO: 21 - protein, 199 aa, Streptococcus agalactiae
GDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKV

SEQ ID NO: 22 - protein, 151 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGA

SEQ ID NO: 23 - protein, 172 aa, Streptococcus agalactiae
TERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVT

SEQ ID NO: 24 - protein, 143 aa, Streptococcus agalactiae
DEATTNTVTLHKILQTESNLNKSNFPGTTGLNGDDYKGESISDLAEYFGSGSKEIDGAFFALALEEEKDGVVQYVKAKANDKLTPDLITKGTPATTTKVEEAVGGLTTGTGIVFNTAGLKGNFKIIELKDKSTYNNNGSLLAA

SEQ ID NO: 25 - protein, 200 aa, Streptococcus agalactiae
NGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTD

SEQ ID NO: 26 - protein, 149 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAG

SEQ ID NO: 27 - protein, 169 aa, Streptococcus agalactiae
ADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVT

SEQ ID NO: 28 - protein, 139 aa, Streptococcus agalactiae
EEERTTETVTLHKILQTETNLKNSAFPGTKGLDGTEYDGKAIDKLDSYFGNDSKDIGGAYFILANSKGEYIKANDKNKLKPEFSGNTPKTTLNISEAVGGLTEENAGIKFETTGLRGDFQIIELKDKSTYNNGGAILAD

SEQ ID NO: 29 - protein, 183 aa, Streptococcus agalactiae
GGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTE

SEQ ID NO: 30 - protein, 143 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAG

SEQ ID NO: 31 - protein, 173 aa, Streptococcus agalactiae
SERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVT

SEQ ID NO: 32 - protein, 133 aa, Streptococcus agalactiae
DDVTTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDTGFAFNTAKLKGTYQIVELKEKSNYDNNGSILADS

SEQ ID NO: 33 - protein, 183 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEE

SEQ ID NO: 34 - protein, 144 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGA

SEQ ID NO: 35 - protein, 172 aa, Streptococcus agalactiae
TERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVT

SEQ ID NO: 36 - protein, 121 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPL

SEQ ID NO: 37 - protein, 105 aa, Streptococcus agalactiae
NPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYE

SEQ ID NO: 38 - protein, 116 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPI

SEQ ID NO: 39 - protein, 107 aa, Streptococcus agalactiae
NPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 40 - protein, 116 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPI

SEQ ID NO: 41 - protein, 107 aa, Streptococcus agalactiae
NPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 42 - protein, 123 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPL

SEQ ID NO: 43 - protein, 108 aa, Streptococcus agalactiae
NPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYE

SEQ ID NO: 44 - protein, 123 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPL

SEQ ID NO: 45 - protein, 107 aa, Streptococcus agalactiae
NPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYT

SEQ ID NO: 46 - protein, 116 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPI

SEQ ID NO: 47 - protein, 108 aa, Streptococcus agalactiae
NPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 48 - protein, 116 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPI

SEQ ID NO: 49 - protein, 107 aa, Streptococcus agalactiae; identical to SEQ ID NO: 41

SEQ ID NO: 50 - protein, 308 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVT

SEQ ID NO: 51 - protein, 226 aa, Streptococcus agalactiae
GNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYE

SEQ ID NO: 52 - protein, 502 aa, Streptococcus agalactiae
NGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVT

SEQ ID NO: 53 - protein, 420 aa, Streptococcus agalactiae
NGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYE

SEQ ID NO: 54 - protein, 309 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVT

SEQ ID NO: 55 - protein, 223 aa, Streptococcus agalactiae
GNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 56 - protein, 485 aa, Streptococcus agalactiae
DGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVT

SEQ ID NO: 57 - protein, 399 aa, Streptococcus agalactiae
DGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 58 - protein, 309 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVT

SEQ ID NO: 59 - protein, 223 aa, Streptococcus agalactiae
GNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 60 - protein, 485 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVT

SEQ ID NO: 61 - protein, 399 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 62 - protein, 316 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVT

SEQ ID NO: 63 - protein, 231 aa, Streptococcus agalactiae
GNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYE

SEQ ID NO: 64 - protein, 507 aa, Streptococcus agalactiae
GDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVT

SEQ ID NO: 65 - protein, 422 aa, Streptococcus agalactiae
GDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYE

SEQ ID NO: 66 - protein, 311 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVT

SEQ ID NO: 67 - protein, 230 aa, Streptococcus agalactiae
GNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYT

SEQ ID NO: 68 - protein, 504 aa, Streptococcus agalactiae
NGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVT

SEQ ID NO: 69 - protein, 423 aa, Streptococcus agalactiae
NGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYT

SEQ ID NO: 70 - protein, 310 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVT

SEQ ID NO: 71 - protein, 224 aa, Streptococcus agalactiae
GNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 72 - protein, 486 aa, Streptococcus agalactiae
GGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVT

SEQ ID NO: 73 - protein, 400 aa, Streptococcus agalactiae
GGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 74 - protein, 309 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVT

SEQ ID NO: 75 - protein, 223 aa, Streptococcus agalactiae
GNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 76 - protein, 485 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVT

SEQ ID NO: 77 - protein, 399 aa, Streptococcus agalactiae
NGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 78 - protein, 26 aa, Streptococcus agalactiae
TYRVIERVSGYAPEYVSFVNGVVTIK

SEQ ID NO: 79 - protein, 6 aa, Artificial Sequence
  His tag
HHHHHH

SEQ ID NO: 80 - protein, 4 aa, Artificial Sequence
  Linker
GSGS

SEQ ID NO: 81 - protein, 6 aa, Artificial Sequence
  Linker
GSGGGG

SEQ ID NO: 82 - protein, 8 aa, Artificial Sequence
  Linker
GSGSGGGG

SEQ ID NO: 83 - protein, 736 aa, Streptococcus agalactiae
MGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPIGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPIGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLGSGSGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLGSGSGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPI

SEQ ID NO: 84 - protein, 1378 aa, Streptococcus agalactiae
MGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEGSGSGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEGSGSGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYE

SEQ ID NO: 85 - protein, 916 aa, Streptococcus agalactiae
MGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEGSGSGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 86 - protein, 916 aa, Streptococcus agalactiae
MGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEGSGSGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEGSGSGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYE

SEQ ID NO: 87 - protein, 1227 aa, Streptococcus agalactiae
MDGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEGSGSNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEGSGSNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYE

SEQ ID NO: 88 - DNA, 2214 bp, Streptococcus agalactiae
atgggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttggatccggatccggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcggatccggatccggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgggatccggatccggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttggatccggatccggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatctaatga

SEQ ID NO: 89 - DNA, 4140 bp, Streptococcus agalactiae
atgggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaaggatccggatccggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaaggatccggatccggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacaggatccggatccggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagggatccggatccggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaataatga

SEQ ID NO: 90 - DNA, 2754 bp, Streptococcus agalactiae
atgggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaaggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagggatccggatccggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaataatga

SEQ ID NO: 91 - DNA, 2754 bp, Streptococcus agalactiae
atgggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaaggatccggatccggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagggatccggatccggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaataatga

SEQ ID NO: 92 - DNA, 3687 bp, Streptococcus agalactiae
atggatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaaggatccggatccaatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagggatccggatccaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaataatga

SEQ ID NO: 93 - DNA, 2225 bp, Streptococcus agalactiae
ggtaccatatgggcaataatccgaccattgaaaatgaaccgaaagaaggcattccggttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgttagcggttatgcaccggaatatgttagctttgtgaacggcgtggtgaccattaaaaacaataaagatagcaatgaaccgaccccgattggtagcggtagcggtaataaaccgggtaaaaaagttaaagaaattccggttaccccgagcaatggtgaaattaccgtttctaaaacctgggataaaggtagcgatctggaaaatgccaatgttgtttataccctgaaagatggtggtacagcagttgcaagcgttagcctgaccaaaaccaccccgaatggcgaaattaatctgggtaatggtatcaaatttaccgttaccggtgcatttgcaggcaaatttagcggtctgaccgatagcaaaacctacatgattagcgaacgcattgcaggttatggtaataccattaccaccggtgcaggtagcgcagcaattaccaatacaccggatagcgataatccgacacctctgggttctggttctggtaataatccgacagaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttaccggtctggacaacgccaaaacctaccgcgtggtggaacgtgtttctggttatacccctgaatatgtgagctttaaaaacggtgttgtgaccatcaaaaataacaaaaattctaatgatccgacaccgatcggttctggttctggcaataaacctggtaaagacctgaccgaactgccggtgaccccgtctaaaggtgaagtgaccgttgcaaaaacctggtctgatggtattgcaccggatggtgttaacgtggtgtatacgctgaaagataaagataaaaccgttgccagcgtttctctgaccaaaacaagcaaaggcaccattgatctgggcaacggcatcaaatttgaagtgagcggtaattttagcggcaaattcacaggcctggaaaacaaaagttatatgatttcagaacgtgtgagtggttatggtagcgccattaatctggaaaacggcaaagtgaccattaccaataccaaagattctgataatcctacccctctgggttcaggttcaggtaataaaccaggcaccgatctgtctgaacagccggttacacctgaagatggtgaagttaaagttaccaaaacatgggcagccggtgcaaataaagcagatgcgaaagttgtgtatacactgaaaaatgcaaccaaacaggttgttgcaagcgtggcactgaccgcagcagataccaaaggtacaattaacctgggcaaaggtatgacctttgaaattaccggtgcctttagcggtacatttaaaggtctgcagaataaagcatataccgttagcgaacgtgtggcaggttataccaatgcaattaatgttaccggtaatgcagttgccattacgaatacccctgactcagataacccgacaccactgggtagtggcagcggtaacaatccgacaaccgaaaatgaacctcagaccggtaatccggtgaataaagaaattacagttcgtaaaacatgggctgtggatggcaacgaagttaataaaggtgatgaaaaagtggatgccgtgtttacgctgcaggttaaagattcagataaatgggtgaacgtggattctgcaaccgcaaccgcagccacggattttaaatatacgtttaaaaacctggataacgcgaaaacgtatcgtgttgttgaacgcgtgtctggttatgctccggcttatgtttcttttgtgggtggcgttgttacgattaaaaacaacaaaaacagtaacgatccgacgccgattctcgagctc

SEQ ID NO: 94 - DNA, 4151 bp, Streptococcus agalactiae
ggtaccatatgggcaataatccgaccattgaaaatgaaccgaaagaaggcattccggttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgttagcggttatgcaccggaatatgttagctttgtgaacggcgtggtgaccattaaaaacaataaagatagcaatgaaccgaccccgattaatccgagcgaaccgaaagttgtgacctatggtcgcaaatttgtgaaaaccaacaaagatggtaaagaacgtctggcaggcgcaacctttctggttaaaaaagatggcaaatatctggcacgtaaaagcggtgttgcaaccgatgcagaaaaagcagcagttgatagcaccaaaagcgcactggatgcagcagttaaagcctataatgatctgaccaaagaaaaacaggaaggtcaggacggtaaatctgcactggcaaccgttagcgaaaaacagaaagcctataacgatgcctttgtgaaagcaaattatagctatgaaggtagcggtagcggtaataatccgacagaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttaccggtctggataacgcaaaaacatatcgcgtggtggaacgtgtttctggttatacccctgaatatgtgagctttaaaaacggtgttgtgaccatcaaaaataacaaaaactctaatgatccgacaccgatcaacccgtctgaaccgaaagtggttacgtatggccgtaaatttgttaaaacaaatcaggcaaataccgaacgcctggctggtgccacatttctggtgaaaaaagaaggtaaatatctggctcgcaaagccggtgcagcaaccgcagaagcaaaagcagccgttaaaaccgcaaaactggcactggatgaagccgtgaaagcgtataacgatctgacaaaagaaaaacaggaaggccaggaaggtaaaaccgctctggccaccgtggatcagaaacagaaagcgtataatgatgcgtttgttaaagccaactattcttatgaaggttctggttctggtaataaaccgggtacagatctgagcgaacagccggttacaccggaagatggtgaagttaaagttaccaaaacatgggcagccggtgcaaataaagcagatgccaaagttgtgtataccctgaaaaatgcaaccaaacaggttgttgcaagcgttgcactgaccgcagcagataccaaaggtacaattaacctgggcaaaggtatgacctttgaaattaccggtgcatttagcggcacctttaaaggtctgcagaataaagcatataccgtttctgaacgtgttgcaggctataccaatgcaattaatgttaccggtaatgcagttgcaattaccaatacaccggatagcgataatccgacaccgctgaatccgacccagccgaaagttgaaacccatggcaaaaaatttgttaaagttggtgatgcagatgcacgtctggctggcgcgcagtttgttgtgaaaaatagcgcaggcaaatttctggccctgaaagaagatgcagccgttagcggtgcacagaccgaactggcaaccgcaaaaaccgatctggataatgcgattaaagcatataatggcctgacaaaagcccagcaggaaggtgcagacggcaccagcgcaaaagaactgattaataccaaacagagcgcctatgatgcagcatttatcaaagcacgtaccgcatataccggtagcggttcaggcaataaacctggcaaagatctgacagaactgccggtgaccccgagcaaaggtgaagttaccgttgcaaaaacctggtctgatggtattgcaccggatggtgttaatgtggtgtatacgctgaaagataaagataaaaccgttgccagcgttagcctgaccaaaaccagcaaaggcaccattgatctgggtaatggcatcaaatttgaagtgagcggtaattttagcggcaaatttacaggcctggaaaacaaaagctatatgattagcgaacgtgttagtggctatggtagcgccattaatctggaaaatggcaaagtgaccatcaccaataccaaagattctgataacccgacccctctgaatcctacagaacctaaagtggaaacgcatggtaaaaaatttgtgaaaacaaatgaacagggtgatcgcctggccggcgctcaatttgtggttaaaaactctgccggtaaatatctggcactgaaagcagatcagagcgaaggtcagaaaaccctggcagccaaaaaaatcgccctggatgaagcaattgcagcatataacaaactgagcgccaccgatcagaaaggtgaaaaaggcattaccgccaaagaactgatcaaaacaaaacaggccgattatgatgccgcttttattgaagcccgtacagcctatgaaggttcaggtagcggcaacaaaccgggtaaaaaagttaaagaaattcctgttacaccgtctaatggtgaaattactgtgtctaaaacatgggataaaggtagcgatctggaaaacgcgaacgttgtttatacactgaaagatggtggtacagcagttgcgtctgtttctctgaccaaaacaaccccgaatggtgaaatcaatctgggcaacggtatcaaatttaccgttaccggtgctttcgctggcaaatttagcggtctgaccgattctaaaacctacatgatttccgaacgcattgcaggttatggtaataccattaccaccggtgcaggtagcgcagccattaccaatacccctgattcagacaatcctacaccactgaacccgacggaaccaaaagttgtgacacatggcaaaaaatttgtgaaaaccagcagcaccgaaaccgaacgtctgcagggtgcacagtttgttgttaaagattcagctggcaaatatctggcgctgaaaagcagcgcaaccattagcgcacagaccaccgcatatacaaatgcaaaaacagccctggatgccaaaatcgctgcctataacaaactgtctgcagatgatcagaaaggcaccaaaggtgaaaccgcaaaagcagaaatcaaaaccgcacaggatgcatataatgcagcctttattgttgcacgtaccgcgtatgaaggtagtggctctggtaacaatccgacaaccgaaaatgaacctcagaccggtaatccggtgaataaagaaattacagttcgtaaaacgtgggctgtggatggcaacgaagttaataaaggtgatgaaaaagtggatgccgtgtttacgctgcaggttaaagattcagataaatgggtgaacgttgattctgcaaccgcaaccgcagccacggattttaaatatacgtttaaaaacctggataacgcgaaaacgtatcgtgttgttgaacgcgtgtctggttatgctccggcttatgtttcttttgtgggtggcgttgttacgattaaaaacaacaaaaacagcaacgatcctactccgattaatccttcagaaccaaaagtggttacctatggccgtaaatttgtgaaaactaaccaggatggctctgaacgtctggctggtgcgacttttctggttaaaaacagccagagccagtatctggcacgcaaatctggtgttgccaccaatgaagcacataaagcagttaccgatgccaaagttcagctggatgaagcggttaaagcgtacaacaaactgacgaaagaacagcaggaatcacaggacggcaaagcagcactgaatctgattgatgaaaaacagacggcttataacgaagcgtttgccaaagcgaattattcctatgaactcgagctc

SEQ ID NO: 95 - DNA, 2765 bp, Streptococcus agalactiae
ggtaccatatgggtaataaaccgggtaaagatctgaccgaactgccggttaccccgagcaaaggtgaagttaccgttgcaaaaacctggtctgatggtattgcaccggatggtgttaatgtggtgtataccctgaaagataaagataaaaccgttgcaagcgttagcctgaccaaaaccagcaaaggcaccattgatctgggtaatggcatcaaatttgaagtgagcggtaattttagcggcaaatttaccggtctggaaaacaaaagctatatgattagcgaacgtgttagcggttatggtagcgccattaatctggaaaatggcaaagtgaccatcaccaataccaaagatagcgataatccgacaccgctgaatccgaccgaaccgaaagttgaaacccatggcaaaaaatttgttaaaaccaatgaacagggtgatcgtctggcaggcgcacagtttgttgtgaaaaatagcgcaggtaaatatctggcactgaaagcagatcagagcgaaggtcagaaaaccctggcagccaaaaaaatcgcactggatgaagcaattgcagcatataacaaactgagcgccaccgatcagaaaggtgaaaaaggcattaccgccaaagaactgatcaaaaccaaacaggccgattatgatgcagcatttattgaagcacgtaccgcctatgaaggtagcggtagcggtaataatccgaccattgaaaatgaaccgaaagaaggcattccggttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgtttctggctatgcaccggaatatgttagctttgtgaacggcgtggtgaccattaaaaacaataaagatagcaatgaaccgaccccgattaatccgtctgaacctaaagttgtgacctatggtcgcaaatttgtgaaaacgaacaaagatggtaaagaacgtctggctggtgcaacctttctggttaaaaaagatggcaaatatctggctcgtaaaagcggtgttgcaaccgatgcagaaaaagcagcagttgatagcaccaaaagtgcactggatgcagcagttaaagcctataatgatctgaccaaagaaaaacaggaaggtcaggacggtaaaagcgcactggcaaccgttagcgaaaaacagaaagcctataacgatgcctttgtgaaagccaattatagctatgaaggttctggcagcggcaataaacctggtaaaaaagttaaagaaattccggtgaccccgtctaatggtgaaattaccgtgtctaaaacatgggataaaggtagcgatctggaaaacgccaacgttgtttatacactgaaagatggtggtacagcagttgccagcgtttctctgaccaaaacaaccccgaatggcgaaattaatctgggcaacggtatcaaatttaccgttaccggtgcatttgcaggcaaattttctggtctgaccgatagcaaaacctacatgatctctgaacgcattgcaggttatggtaataccattaccaccggtgcaggtagcgcagcaattaccaatacaccggattctgataacccgacccctctgaaccctacagaaccaaaagtggtgacgcatggtaaaaaatttgtgaaaacaagcagcaccgaaaccgaacgtctgcagggtgcccagtttgttgttaaagattctgctggcaaatatctggccctgaaaagcagcgcaaccattagcgcacagaccaccgcatataccaatgcaaaaaccgctctggatgcaaaaatcgctgcctataacaaactgtctgcagatgatcagaaaggcaccaaaggtgaaaccgcaaaagcagaaatcaaaaccgcacaggatgcatataatgcagcctttattgttgctcgcacagcgtatgaaggttcaggttctggtaataacccgaccgaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttacaggtctggataacgcaaaaacatatcgcgtggtggaacgtgtgtctggttatacccctgaatatgtgagctttaaaaacggtgttgtgaccatcaaaaataacaaaaactctaatgatccgacacctattaacccgagtgaaccgaaagtggttacgtatggccgtaaatttgttaaaacaaatcaggcaaataccgaacgcctggcaggagctacatttctggtcaaaaaagaaggtaaatatctggcacgcaaagccggtgcagcaaccgcagaagcaaaagcagccgttaaaaccgcaaaactggccctggatgaagccgtgaaagcgtataacgatctgacaaaagaaaaacaggaaggtcaggaaggcaaaacagccctggccaccgttgatcagaaacagaaagcgtataatgatgcgtttgttaaagcgaactattcctatgaactcgagctc

SEQ ID NO: 96 - DNA, 2765 bp, Streptococcus agalactiae
ggtaccatatgggtaataatccgaccgaagaaagcgaaccgcaggaaggtacaccggcaaaccaggaaattaaagttattaaagattgggcagttgatggtacaattaccgatgccaatgttgcagttaaagccatttttaccctgcaggaaaaacagaccgacggtacatgggttaatgttgcaagccatgaagcaaccaaaccgagccgttttgaacatacctttaccggtctggataatgcaaaaacctatcgtgttgttgaacgtgttagcggttatacaccggaatatgtgagctttaaaaacggcgtggtgaccatcaaaaataacaaaaacagcaatgatccgaccccgattaatccgagcgaaccgaaagttgtgacctatggtcgtaaatttgtgaaaaccaatcaggcaaataccgaacgtctggcaggcgcaacctttctggttaaaaaagaaggtaaatatctggcacgtaaagccggtgcagcaaccgcagaagcaaaagcagcagttaaaaccgcaaaactggcactggatgaagcagttaaagcgtataatgatctgaccaaagaaaaacaggaaggtcaggaaggcaaaaccgcactggcaaccgttgatcagaaacagaaagcctataacgatgcctttgtgaaagcaaattatagctatgaaggtagcggtagcggtaataaaccgggtaaaaaagttaaagaaattccggttaccccgagcaatggtgaaattaccgttagcaaaacctgggataaaggtagcgatctggaaaatgccaatgtggtttataccctgaaagatggtggtacagcagttgcaagcgttagcctgaccaaaaccaccccgaatggcgaaattaatctgggtaatggtatcaaatttaccgttaccggtgcatttgcaggcaaatttagcggtctgaccgattctaaaacctacatgattagcgaacgcattgcaggttatggtaataccattaccaccggtgcaggtagcgcagcaattaccaatacaccggatagcgataatccgacaccactgaacccgactgaaccgaaagtggttacccatggcaaaaaatttgttaaaacctctagcaccgaaaccgaacgcctgcagggtgcacagtttgttgttaaagatagcgcaggcaaatatctggccctgaaaagcagcgcaaccattagcgcacagaccaccgcatataccaatgcaaaaacagcactggatgccaaaattgcagcatataacaaactgagcgcagatgatcagaaaggtacaaaaggcgaaaccgcaaaagccgaaatcaaaaccgcacaggatgcatataatgcagcatttattgttgcacgtaccgcctatgaaggttctggttctggtaataaacctggcaaagatctgaccgaactgccggtgaccccgtctaaaggtgaagtgaccgtggcaaaaacctggtctgatggtattgcaccggatggtgtgaacgttgtgtatacgctgaaagataaagataaaaccgttgccagcgtttctctgaccaaaacaagcaaaggcaccattgatctgggcaacggcatcaaatttgaagtgagcggtaattttagcggcaaatttacaggcctggaaaacaaaagctatatgatttctgaacgtgtgtctggttatggtagcgccattaatctggaaaacggcaaagtgaccattaccaataccaaagattctgataaccctacccctctgaatcctacagaacctaaagttgaaacgcacggtaaaaaattcgtgaaaacaaatgaacagggtgatcgtctggctggtgcccagtttgtggtgaaaaattctgccggtaaatatctggcgctgaaagccgatcagagcgaaggtcagaaaaccctggcagccaaaaaaatcgccctggatgaagcaatcgctgcctataacaaactgtctgcaaccgatcagaaaggcgaaaaaggcattaccgccaaagaactgatcaaaaccaaacaggccgattatgatgcagcctttattgaagctcgcacagcgtatgaaggttcaggtagcggcaataatccgacaattgaaaatgaaccgaaagaaggcattccggttgataaaaaaatcaccgtgaataaaacctgggcagtggatggcaatgaagttaataaagccgatgaaaccgttgatgcagtgtttacactgcaggttaaagatggtgataaatgggtgaatgttgatagcgcaaaagcaaccgcagcaaccagctttaaacatacctttgaaaacctggataacgccaaaacatatcgcgttatcgaacgcgtttctggttatgcccctgaatatgttagctttgtgaatggtgttgtgaccattaaaaacaataaagattctaatgaaccgacacctattaacccgtctgaacctaaagtggttacgtatggtcgcaaatttgttaaaacgaacaaagatggtaaagaacgcctggctggtgcgacattcctggtcaaaaaagatggcaaatatctggctcgcaaaagcggtgttgcaaccgatgccgaaaaagcagccgttgatagcaccaaaagcgcactggatgccgctgtgaaagcctataacgatctgacaaaagaaaaacaggaaggccaggacggtaaatctgccctggccaccgttagcgaaaaacagaaagcgtataatgatgcgtttgttaaagccaactattcctatgaactcgagctc

SEQ ID NO: 97 - DNA, 3698 bp, Streptococcus agalactiae
ggtaccatatggatggtagcattctggcagatagcaaagcagttccggtgaaaattaccctgccgctggttaatgataatggtgttgtgaaagatgcccatgtgtatccgaaaaataccgaaaccaaaccgcaggttgataaaaactttgccgataaagaactggattatgccaacaacaaaaaagataaaggcaccgttagcgccagcgttggtgatgttaaaaaatatcatgtgggcaccaaaatcctgaaaggcagcgattataaaaaactgatctggaccgatagcatgaccaaaggcctgacctttaataacgatattgcagttaccctggatggtgcaaccctggatgcaaccaactataaactggttgcagatgatcagggttttcgtctggttctgaccgataaaggtctggaagcagttgcaaaagcagccaaaaccaaagatgtggaaatcaaaattacctatagcgcaaccctgaatggtagcgcagttgttgaagttctggaaaccaacgatgtgaaactggattatggcaataatccgaccattgaaaatgaaccgaaagaaggcatccctgttgataaaaaaattaccgtgaacaaaacctgggcagttgatggtaatgaagtgaataaagccgatgaaaccgttgatgcagtttttaccctgcaggttaaagatggtgataaatgggttaatgttgatagcgcaaaagcaaccgcagcaaccagctttaaacatacctttgaaaacctggataatgccaaaacctatcgtgttattgaacgtgttagcggttatgcaccggaatatgttagctttgtgaacggcgtggtgaccattaaaaacaataaagatagcaatgaaccgaccccgattaatccgagcgaaccgaaagttgtgacctatggtcgcaaatttgtgaaaaccaacaaagatggtaaagaacgtctggcaggcgcaacctttctggttaaaaaagatggcaaatatctggcacgtaaaagcggtgttgcaaccgatgcagaaaaagcagcagttgatagcaccaaaagcgcactggatgcagcagttaaagcctataatgatctgaccaaagaaaaacaggaaggtcaggacggtaaatctgcactggcaaccgttagcgaaaaacagaaagcctataacgatgcctttgtgaaagcaaattatagctatgaaggtagcggtagcaatggtagcctgctggcagcatctaaagccgtgccggttaatatcacactgccgctggtgaacgaagatggtgtggttgccgatgcacatgtttatcctaaaaacacggaagaaaaaccggaaatcgataaaaactttgcgaaaaccaatgatctgacagcactgaccgatgttaatcgtctgctgaccgcaggcgcaaattatggtaattatgcacgcgataaagcaaccgccaccgcagaaattggtaaagtggtgccgtatgaagtgaaaaccaaaattcataaaggcagcaaatatgaaaatctggtgtggaccgatattatgagcaatggtctgaccatgggtagcaccgttagcctgaaagcaagcggtacaaccgaaacctttgccaaagataccgattatgaactgagcattgatgcacgtggttttaccctgaaatttaccgcagatggtctgggcaaactggaaaaagccgcaaaaaccgcagatattgaattcaccctgacctattctgcaaccgttaatggtcaggccattattgataacccggaaagcaacgatattaaactgagctatggcaataaaccgggtaaagatctgaccgaactgccggttaccccgagcaaaggtgaagttaccgttgcaaaaacctggtctgatggtattgcaccggatggtgttaatgtggtgtataccctgaaagataaagataaaaccgttgcaagcgttagcctgaccaaaaccagcaaaggcaccattgatctgggtaatggcatcaaatttgaagtgagcggtaattttagcggcaaatttaccggtctggaaaacaaaagctatatgattagcgaacgtgtttctggttatggtagcgccattaatctggaaaatggcaaagtgaccatcaccaataccaaagatagcgataatccgacaccgctgaatccgacagaacctaaagtggaaacccatggcaaaaaatttgttaaaacaaatgaacagggtgatcgtctggctggtgcacagtttgttgtgaaaaatagcgcaggtaaatatctggccctgaaagcagatcagagcgaaggtcagaaaaccctggcagccaaaaaaatcgccctggatgaagcaattgcagcatataacaaactgagcgccaccgatcagaaaggtgaaaaaggcattaccgccaaagaactgatcaaaaccaaacaggccgattatgatgcagcatttattgaagcacgtaccgcctatgaaggttctggttctaatggttctattctggccgattcaaaagcggttcctgttaaaatcactctgcctctggttaacaatcagggcgttgttaaagatgcgcatatctatccaaaaaacacggaaacgaaacctcaggtggataaaaactttgcggataaagatctggattataccgataatcgtaaagataaaggtgttgttagcgccaccgtgggcgataaaaaagaatatattgttggtacgaaaattctgaaaggttctgattataaaaaactggtgtggacagattctatgacgaaaggtctgacgtttaacaataatgtgaaagtgaccctggatggcgaagattttccggttctgaactataaactggtgaccgatgatcagggctttcgcctggcactgaatgcaaccggtctggcagccgtggcagcagcagcaaaagataaagatgttgaaatcaaaatcacatattcagccaccgtgaatggtagcaccaccgtggaaattccagaaacgaatgatgttaaactggattatggtaacaacccgacagaagaaagcgaaccgcaggaaggtacaccggcaaaccaggaaattaaagttattaaagattgggcagtggatggcaccattaccgatgcaaatgttgccgttaaagccatttttacactgcaggaaaaacagaccgacggtacatgggtgaatgttgcaagccatgaagcaaccaaaccgagccgttttgaacatacctttacaggtctggataacgcaaaaacatatcgcgttgtggaacgtgtttcaggctatacccctgaatatgtgagctttaaaaacggtgttgtgaccatcaaaaataacaaaaactctaatgatccgacaccgatcaacccgtctgaaccaaaagtggttacgtatggccgtaaatttgttaaaaccaatcaggcaaataccgaacgcctggctggtgccacatttctggtgaaaaaagaaggtaaatatctggctcgcaaagccggtgcagcaaccgcagaagcaaaagccgcagttaaaaccgcaaaactggcactggatgaagccgtgaaagcgtataacgatctgacaaaagaaaaacaggaaggccaggaaggtaaaacagctctggccaccgtggatcagaaacagaaagcgtataatgatgcgtttgttaaagccaactattcctatgaactcgagctc

SEQ ID NO: 98 - DNA, 26 bp, Artificial Sequence
  IC adjuvant
  i 1 ... 26: EACH N IS INOSINE - i
ncncncncncncncncncncncncnc

SEQ ID NO: 99 - protein, 11 aa, Artificial Sequence
  Polycationic peptide adjuvant
KLKLLLLLKLK

SEQ ID NO: 100 - DNA, 2118 bp, Streptococcus agalactiae
atgaaaagaatcaacaaatattttgcaatgttctcggcattgttactgactttaacgtcattgctctcagttgcaccagcgtttgcggatgaagcaacaactaatacagtgactttgcacaagattttgcaaaccgaatcaaatcttaacaaaagtaacttcccaggaactacaggtcttaacggaaaagactacaaaggtggagctatttctgaccttgctggttactttggcgagggatctaaagaaatcgaaggtgcgttctttgctttagctttgaaagaagataaaagtggtaaagtgcaatatgttaaggcaaaagaaggtaacaaattaacaccagccttaattaataaagatggtactcctgaaataacagtaaatattgatgaggccgtgtctggattgacaccagagggagatactggacttgttttcaacaccaaaggattgaaaggcgagtttaaaattgttgaagttaaatcaaaatctacttacaacaataatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaacaatcccacaaacaggtggtattggtacaattcttttcacaattattggtttaagcattatgcttggagcagtagttatcatgaaaagacgccaatcaaaggaagcttaa

SEQ ID NO: 101 - DNA, 2028 bp, Streptococcus agalactiae
atgaaaaaaatcaacaaatattttgcagtcttctcggcattgctactgaccgtaacatcattgttctcagttgcaccagtgtttgcggaagaagcaaaaactactgacacagtgaccttgcacaagattgtcatgcctcgaactgcatttgacggttttactgctggtacaaagggtaaggataatactgactacgttggtaaacaaatcgaagaccttaaaacttactttggctcaggcgaagcgaaagaaatcgcaggtgcttactttgctttcaaaaatgaagctggtactaaatacatcactgaaaatggtgaagaagttgatactttggatacaacagatgccaaaggttgtgctgttcttaaaggtttaacaacagacaatggtttcaaatttaacacttctaaattaacaggaacttaccaaatcgttgaattgaaagaaaaatctacatacaacaacgatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttactattccacaaacaggtggtattggtacaatttttttcacaattattggattaagtattatgcttggagcggtagttatcatgaaaagacgtcaatcagaggaagtttaa

SEQ ID NO: 102 - DNA, 2025 bp, Streptococcus agalactiae
atgaaaaaaatcaacaaatgtcttacaatgttctcgacactgctattgatcttaacgtcactattctcagttgcaccagcgtttgcggacgacgcaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaatcaagggtgctttctttgttttcaaaaatgaaactggtacaaaattcattactgaaaatggtaaggaagtcgatactttggaagctaaagatgctgaaggtggtgctgttctttcagggttaacaaaagacaatggttttgtttttaacactgctaagttaaaaggaatttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaaccatcccacaaacaggtggtattggtacaattcttttcacaattattggtttaagcattatgcttggagcagtagttatcatgaaaaaacgtcaatcagaggaagcttaa

SEQ ID NO: 103 - DNA, 2082 bp, Streptococcus agalactiae
atgaaaagaatcaacaaatattttgcaatgttctcggcattgttattaattttaacatcgttgttatcggtagctccggtatttgctgctgagatgggaaatatcactaaaacagtaaccttacacaaaattgttcaaacatccgataatttggctaagccaaatttcccaggaataaatggattgaatggaacgaagtatatgggtcaaaaacttactgacatttcaggatattttgggcaaggttctaaagaaatcgccggtgctttctttgcggttatgaatgaaagtcagacaaaatatatcacagaaagtggtactgaagtagaaagtatcgatgcagcaggtgtccttaaaggtttgacaactgaaaacggcattacatttaatactgcaaacttaaaaggaacataccaaatcgttgagttgcttgacaaatctaattataaaaatggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgactattccacaaacaggtggtattggtacaattcttttcacaattattggtttaagcattatgcttggagcggtaattatcatgaaaagacgtcaatcagaggaagcttaa

SEQ ID NO: 104 - DNA, 2115 bp, Streptococcus agalactiae
atgaaaaaaatcaacaaatattttgcagtcttctcggccttgctactgaccgtaacatcattgctctcagttgcaccagcgtttgcggacgaagcaacaactaatacagtgactttgcacaagatcttgcaaactgaatcaaatcttaataaaagtaacttcccaggaactacaggccttaacggagatgactataaaggtgaatctatttctgaccttgctgaatactttggatcaggttctaaagaaattgacggtgctttctttgctttggctttagaagaggaaaaagatggtgtcgtacaatatgttaaggcaaaagcaaatgacaaattaacaccagacttaattactaaaggtacacctgcaacaacaacaaaagttgaagaagctgtaggtggtttgacaactggtacgggtattgttttcaatacagctggtttgaaaggtaatttcaaaattattgaattgaaagacaaatcaacttacaacaataatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaaccatcccacaaacaggtggtattggtacaattcttttcacaattattggtttaagcattatgcttggagcggtagttatcatgaaaagacgtcaatcagaggaagcttaa

SEQ ID NO: 105 - DNA, 2049 bp, Streptococcus agalactiae
atgaaaaaaatcaacaaattttttgtggcgttctcagcgttgttactgattttaacgtcattgctctcagttgcaccagcgtttgcggaagaagaaagaacaactgagactgttactttgcataaaattttacaaactgagacaaaccttaagaatagtgctttccctggtacaaaagggctagatggaactgaatatgacgggaaagctattgataaattggatagctactttggcaatgactcaaaagatattggtggggcttactttatattggcaaatagcaagggtgaatatatcaaagctaatgataaaaataaattaaagcctgagtttagtgggaacactccgaaaacgaccctcaatattagtgaagctgtaggtggtttgacagaagaaaacgcaggtattaagtttgaaaccactggtttaagaggggatttccagattattgaattgaaagacaagtcaacttacaataatggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaacaatcccacaaacaggtggtattggtacaattcttttcacaattattggtttaagcattatgcttggagcggtagttatcatgaaaagacgtcaatcagaggaagcttaa

SEQ ID NO: 106 - DNA, 2025 bp, Streptococcus agalactiae
atgaaaaaaatcaacaaatgtcttacagtgttctcgacactgctattgatcttaacgtcactattctcagttgcaccagcgtttgcggacgacgtaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaattaagggtgctttctttgttttcaaaaatgaaactggtacaaaattcattactgaaaatggtaaggaagtcgatactttggaagctaaagatgctgaaggtggtgctgttctttcagggttaacaaaagacactggttttgcttttaacactgctaagttaaaaggaacttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaaccatcccacaaacaggtggtattggtacaattcttttcacaattattggtttaagcattatgcttggagcagtagttgtcatgaaaaaacgtcaatcagaggaagcttaa

SEQ ID NO: 107 - DNA, 438 bp, Streptococcus agalactiae
gatgaagcaacaactaatacagtgactttgcacaagattttgcaaaccgaatcaaatcttaacaaaagtaacttcccaggaactacaggtcttaacggaaaagactacaaaggtggagctatttctgaccttgctggttactttggcgagggatctaaagaaatcgaaggtgcgttctttgctttagctttgaaagaagataaaagtggtaaagtgcaatatgttaaggcaaaagaaggtaacaaattaacaccagccttaattaataaagatggtactcctgaaataacagtaaatattgatgaggccgtgtctggattgacaccagagggagatactggacttgttttcaacaccaaaggattgaaaggcgagtttaaaattgttgaagttaaatcaaaatctacttacaacaataatggttccctcctggctgct

SEQ ID NO: 108 - DNA, 603 bp, Streptococcus agalactiae
aatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagac

SEQ ID NO: 109 - DNA, 441 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggt

SEQ ID NO: 110 - DNA, 504 bp, Streptococcus agalactiae
caaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaaca

SEQ ID NO: 111 - DNA, 399 bp, Streptococcus agalactiae
gaagaagcaaaaactactgacacagtgaccttgcacaagattgtcatgcctcgaactgcatttgacggttttactgctggtacaaagggtaaggataatactgactacgttggtaaacaaatcgaagaccttaaaacttactttggctcaggcgaagcgaaagaaatcgcaggtgcttactttgctttcaaaaatgaagctggtactaaatacatcactgaaaatggtgaagaagttgatactttggatacaacagatgccaaaggttgtgctgttcttaaaggtttaacaacagacaatggtttcaaatttaacacttctaaattaacaggaacttaccaaatcgttgaattgaaagaaaaatctacatacaacaacgatggttctatcttggctgat

SEQ ID NO: 112 - DNA, 549 bp, Streptococcus agalactiae
gatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaa

SEQ ID NO: 113 - DNA, 504 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagct

SEQ ID NO: 114 - DNA, 507 bp, Streptococcus agalactiae
ttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttact

SEQ ID NO: 115 - DNA, 399 bp, Streptococcus agalactiae
gacgacgcaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaatcaagggtgctttctttgttttcaaaaatgaaactggtacaaaattcattactgaaaatggtaaggaagtcgatactttggaagctaaagatgctgaaggtggtgctgttctttcagggttaacaaaagacaatggttttgtttttaacactgctaagttaaaaggaatttaccaaatcgttgaattgaaagaaaaatcaaactacgataacaacggttctatcttggctgattca

SEQ ID NO: 116 - DNA, 549 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaa

SEQ ID NO: 117 - DNA, 432 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagct

SEQ ID NO: 118 - DNA, 516 bp, Streptococcus agalactiae
actgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaacc

SEQ ID NO: 119 - DNA, 387 bp, Streptococcus agalactiae
gctgagatgggaaatatcactaaaacagtaaccttacacaaaattgttcaaacatccgataatttggctaagccaaatttcccaggaataaatggattgaatggaacgaagtatatgggtcaaaaacttactgacatttcaggatattttgggcaaggttctaaagaaatcgccggtgctttctttgcggttatgaatgaaagtcagacaaaatatatcacagaaagtggtactgaagtagaaagtatcgatgcagcaggtgtccttaaaggtttgacaactgaaaacggcattacatttaatactgcaaacttaaaaggaacataccaaatcgttgagttgcttgacaaatctaattataaaaatggtgacaaagttcttgctgac

SEQ ID NO: 120 - DNA, 597 bp, Streptococcus agalactiae
ggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagta

SEQ ID NO: 121 - DNA, 453 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgca

SEQ ID NO: 122 - DNA, 516 bp, Streptococcus agalactiae
acagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgact

SEQ ID NO: 123 - DNA, 429 bp, Streptococcus agalactiae
gacgaagcaacaactaatacagtgactttgcacaagatcttgcaaactgaatcaaatcttaataaaagtaacttcccaggaactacaggccttaacggagatgactataaaggtgaatctatttctgaccttgctgaatactttggatcaggttctaaagaaattgacggtgctttctttgctttggctttagaagaggaaaaagatggtgtcgtacaatatgttaaggcaaaagcaaatgacaaattaacaccagacttaattactaaaggtacacctgcaacaacaacaaaagttgaagaagctgtaggtggtttgacaactggtacgggtattgttttcaatacagctggtttgaaaggtaatttcaaaattattgaattgaaagacaaatcaacttacaacaataatggttccctcttagcagct

SEQ ID NO: 124 - DNA, 600 bp, Streptococcus agalactiae
aatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagat

SEQ ID NO: 125 - DNA, 447 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggt

SEQ ID NO: 126 - DNA, 507 bp, Streptococcus agalactiae
gcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaacc

SEQ ID NO: 127 - DNA, 417 bp, Streptococcus agalactiae
gaagaagaaagaacaactgagactgttactttgcataaaattttacaaactgagacaaaccttaagaatagtgctttccctggtacaaaagggctagatggaactgaatatgacgggaaagctattgataaattggatagctactttggcaatgactcaaaagatattggtggggcttactttatattggcaaatagcaagggtgaatatatcaaagctaatgataaaaataaattaaagcctgagtttagtgggaacactccgaaaacgaccctcaatattagtgaagctgtaggtggtttgacagaagaaaacgcaggtattaagtttgaaaccactggtttaagaggggatttccagattattgaattgaaagacaagtcaacttacaataatggtggggccatcttggctgat

SEQ ID NO: 128 - DNA, 549 bp, Streptococcus agalactiae
ggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaa

SEQ ID NO: 129 - DNA, 429 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcagga

SEQ ID NO: 130 - DNA, 519 bp, Streptococcus agalactiae
tctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaaca

SEQ ID NO: 131 - DNA, 399 bp, Streptococcus agalactiae
gacgacgtaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaattaagggtgctttctttgttttcaaaaatgaaactggtacaaaattcattactgaaaatggtaaggaagtcgatactttggaagctaaagatgctgaaggtggtgctgttctttcagggttaacaaaagacactggttttgcttttaacactgctaagttaaaaggaacttaccaaatcgttgaattgaaagaaaaatcaaactacgataacaacggttctatcttggctgattca

SEQ ID NO: 132 - DNA, 549 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaa

SEQ ID NO: 133 - DNA, 432 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagct

SEQ ID NO: 134 - DNA, 516 bp, Streptococcus agalactiae
actgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaacc

SEQ ID NO: 135 - DNA, 363 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattg

SEQ ID NO: 136 - DNA, 315 bp, Streptococcus agalactiae
aacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgag

SEQ ID NO: 137 - DNA, 348 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatc

SEQ ID NO: 138 - DNA, 321 bp, Streptococcus agalactiae
aacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaa

SEQ ID NO: 139 - DNA, 348 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatc

SEQ ID NO: 140 - DNA, 321 bp, Streptococcus agalactiae
aacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 141 - DNA, 369 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccactt

SEQ ID NO: 142 - DNA, 321 bp, Streptococcus agalactiae
aatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttac

SEQ ID NO: 143 - DNA, 369 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccactt

SEQ ID NO: 144 - DNA, 321 bp, Streptococcus agalactiae
aacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttataca

SEQ ID NO: 145 - DNA, 348 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatc

SEQ ID NO: 146 - DNA, 324 bp, Streptococcus agalactiae
aatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaa

SEQ ID NO: 147 - DNA, 348 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatc

SEQ ID NO: 148 - DNA, 321 bp, Streptococcus agalactiae
aacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 149 - DNA, 924 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaaca

SEQ ID NO: 150 - DNA, 678 bp, Streptococcus agalactiae
ggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgag

SEQ ID NO: 151 - DNA, 1506 bp, Streptococcus agalactiae
aatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaaca

SEQ ID NO: 152 - DNA, 1260 bp, Streptococcus agalactiae
aatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgag

SEQ ID NO: 153 - DNA, 927 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttact

SEQ ID NO: 154 - DNA, 669 bp, Streptococcus agalactiae
ggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaa

SEQ ID NO: 155 - DNA, 1455 bp, Streptococcus agalactiae
gatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttact

SEQ ID NO: 156 - DNA, 1197 bp, Streptococcus agalactiae
gatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaa

SEQ ID NO: 157 - DNA, 927 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaacc

SEQ ID NO: 158 - DNA, 669 bp, Streptococcus agalactiae
ggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 159 - DNA, 1455 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaacc

SEQ ID NO: 160 - DNA, 1197 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 161 - DNA, 948 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgact

SEQ ID NO: 162 - DNA, 693 bp, Streptococcus agalactiae
ggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgag

SEQ ID NO: 163 - DNA, 1521 bp, Streptococcus agalactiae
ggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgact

SEQ ID NO: 164 - DNA, 1263 bp, Streptococcus agalactiae
ggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttac

SEQ ID NO: 165 - DNA, 933 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaacc

SEQ ID NO: 166 - DNA, 690 bp, Streptococcus agalactiae
ggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttataca

SEQ ID NO: 167 - DNA, 1512 bp, Streptococcus agalactiae
aatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaacc

SEQ ID NO: 168 - DNA, 1269 bp, Streptococcus agalactiae
aatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttataca

SEQ ID NO: 169 - DNA, 930 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaaca

SEQ ID NO: 170 - DNA, 672 bp, Streptococcus agalactiae
ggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaa

SEQ ID NO: 171 - DNA, 1458 bp, Streptococcus agalactiae
ggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaaca

SEQ ID NO: 172 - DNA, 1200 bp, Streptococcus agalactiae
ggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaa

SEQ ID NO: 173 - DNA, 927 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaacc

SEQ ID NO: 174 - DNA, 669 bp, Streptococcus agalactiae
ggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 175 - DNA, 1455 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaacc

SEQ ID NO: 176 - DNA, 1197 bp, Streptococcus agalactiae
aacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaa

SEQ ID NO: 177 - protein, 554 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 178 - protein, 517 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 179 - protein, 525 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTG

SEQ ID NO: 180 - protein, 520 aa, Streptococcus agalactiae
MKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 181 - protein, 483 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 182 - protein, 271 aa, Streptococcus agalactiae
AEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKG

SEQ ID NO: 183 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 184 - protein, 869 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILS

SEQ ID NO: 185 - protein, 858 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGI

SEQ ID NO: 186 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNG

SEQ ID NO: 187 - protein, 251 aa, Streptococcus agalactiae
QTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKG

SEQ ID NO: 188 - protein, 896 aa, Streptococcus agalactiae
MRKYQKFSKILTLSLFCLSQIPLNTNVLGESTVPENGAKGKLVVKKTDDQNKPLSKATFVLKPTSHSESKVEKVTTEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVKGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLHLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKRHKKSSDASIEKD

SEQ ID NO: 189 - protein, 393 aa, Streptococcus agalactiae
SIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVKGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLHLGNG

SEQ ID NO: 190 - protein, 251 aa, Streptococcus agalactiae
QTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKG

SEQ ID NO: 191 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTFYRNGPVREHGTPTKLYINSLKQKNYDIFNFGIDISGFRQVYNEDYKKNQDGTFQKLKEEAFELSDGEITELMKSFSSKPEYYTPIVTSSDASNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 192 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTFYRNGPVREHGTPTKLYINSLKQKNYDIFNFGIDISGFRQVYNEDYKKNQDGTFQKLKEEAFELSDGEITELMKSFSSKPEYYTPIVTSSDASNNEILSKIQQQFEKILTKENSIVNGTIEDPMGDKINLQLGNG

SEQ ID NO: 193 - protein, 251 aa, Streptococcus agalactiae
QTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKG

SEQ ID NO: 194 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPDDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKGILSFILIGGAMMSIAGGIYIWKRYKKSSDMSIKKD

SEQ ID NO: 195 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPDDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNG

SEQ ID NO: 196 - protein, 251 aa, Streptococcus agalactiae
QILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKG

SEQ ID NO: 197 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNHEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPRAKWGSTTNGLTPEQQKQYYLSKVGETFTMKAFMEADDILSQVDRNSQKIIVHITDGVPTRSYAINNFKLGASYESQFEQMKKNGYLNKSNFLLTDKPEDIKGNGESYFLFPLDSYQTQIISGNLQKLHYLDLNLNYPKGTIYRNGPVREHGTPTKLYINSLKQKNYDIFNFGIDISAFRQVYNEDYKKNQDGTFQKLKEEAFELSDGEITELMKSFSSKPEYYTPIVTSSDASNNEILSKIQQQFEKVLTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 198 - protein, 398 aa, Streptococcus agalactiae
TIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPRAKWGSTTNGLTPEQQKQYYLSKVGETFTMKAFMEADDILSQVDRNSQKIIVHITDGVPTRSYAINNFKLGASYESQFEQMKKNGYLNKSNFLLTDKPEDIKGNGESYFLFPLDSYQTQIISGNLQKLHYLDLNLNYPKGTIYRNGPVREHGTPTKLYINSLKQKNYDIFNFGIDISAFRQVYNEDYKKNQDGTFQKLKEEAFELSDGEITELMKSFSSKPEYYTPIVTSSDASNNEILSKIQQQFEKVLTKENSIVNGTIEDPMGDKINLQLGNG

SEQ ID NO: 199 - protein, 251 aa, Streptococcus agalactiae; identical to SEQ ID NO: 193

SEQ ID NO: 200 - protein, 896 aa, Streptococcus agalactiae
MRKYQKFSKILTLSLFCLSQIPLNTNVLGESTVPENGAKGKLVVKKTDDQNKPLSKATFVLKPTSHSESKVEKVTTEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKRHKKSSDASIEKD

SEQ ID NO: 201 - protein, 393 aa, Streptococcus agalactiae
SIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLQLGNG

SEQ ID NO: 202 - protein, 251 aa, Streptococcus agalactiae; identical to SEQ ID NO: 190

SEQ ID NO: 203 - protein, 896 aa, Streptococcus agalactiae
MRKYQKFSKILTLSLFCLSQIPLNTNVLGESTVPENGAKGKLVVKKTDDQNKPLSKATFVLKTTAHPESKIEKVTAEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYHGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSGGEITELMKSFSSKPEYYTPIVTSADVSNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKKHKKSSDASIEKD

SEQ ID NO: 204 - protein, 393 aa, Streptococcus agalactiae
SIIKTINKDEPLDVVFVLDNSNSMKNNGKNNKAKKAGEAVETIIKDVLGANVENRAALVTYGSDIFDGRTVKVIKGFKEDPYHGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSGGEITELMKSFSSKPEYYTPIVTSADVSNNEILSKIQQQFEKILTKENSIVNGTIEDPMGDKINLQLGNG

SEQ ID NO: 205 - protein, 251 aa, Streptococcus agalactiae; identical to SEQ ID NO: 190

SEQ ID NO: 206 - protein, 502 aa, Streptococcus agalactiae
MKKKMIQSLLVASLAFGMAVSPVTPIAFAAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTELPSTGGIGTTIFYIIGAILVIGAGIVLVARRRLRS

SEQ ID NO: 207 - protein, 438 aa, Streptococcus agalactiae
AETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 208 - protein, 438 aa, Streptococcus agalactiae
AETGTITVQDTKKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTE

SEQ ID NO: 209 - protein, 941 aa, Streptococcus agalactiae
MASAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGGGGSGGGGSGGGGSELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 210 - protein, 932 aa, Streptococcus agalactiae
MASAETGTITVQDTQKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGSGGGGELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 211 - protein, 941 aa, Streptococcus agalactiae
MASAETGTITVQDTKKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGGGGSGGGGSGGGGSELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 212 - protein, 931 aa, Streptococcus agalactiae
MASAETGTITVQDTKKGATYKAYKVFDAEIDNANVSDSNKDGASYLIPQGKEAEYKASTDFNSLFTTTTNGGRTYVTKKDTASANEIATWAKSISANTTPVSTVTESNNDGTEVINVSQYGYYYVSSTVNNGAVIMVTSVTPNATIHEKNTDATWGDGGGKTVDQKTYSVGDTVKYTITYKNAVNYHGTEKVYQYVIKDTMPSASVVDLNEGSYEVTITDGSGNITTLTQGSEKATGKYNLEENNNFTITIPWAATNTPTGNTQNGANDDFFYKGINTITVTYTGVLKSGAKPGSADLPENTNIATINPNTSNDDPGQKVTVRDGQITIKKIDGSTKASLQGAIFVLKNATGQFLNFNDTNNVEWGTEANATEYTTGADGIITITGLKEGTYYLVEKKAPLGYNLLDNSQKVILGDGATDTTNSDNLLVNPTVENNKGTEGSGGGGELAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPS

SEQ ID NO: 213 - protein, 890 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 214 - protein, 1434 aa, Streptococcus agalactiae
MLKKCQTFIIESLKKKKHPKEWKIIMWSLMILTTFLTTYFLILPAITVEETKTDDVGITLENKNSSQVTSSTSSSQSSVEQSKPQTPASSVTETSSSEEAAYREEPLMFRGADYTVTVTLTKEAKIPKNADLKVTELKDNSATFKDYKKKALTEVAKQDSEIKNFKLYDITIESNGKEAEPQAPVKVEVNYDKPLEASDENLKVVHFKDDGQTEVLKSKDTAETKNTSSDVAFKTDSFSIYAIVQEDNTEVPRLTYHFQNNDGTDYDFLTASGMQVHHQIIKDGESLGEVGIPTIKAGEHFNGWYTYDPTTGKYGDPVKFGEPITVTETKEICVRPFMSKVATVTLYDDSAGKSILERYQVPLDSSGNGTADLSSFKVSPPTSTLLFVGWSKTQNGAPLSESEIQALPVSSDISLYPVFKESYGVEFNTGDLSTGVTYIAPRRVLTGQPASTIKPNDPTRPGYTFAGWYTAASGGAAFDFNQVLTKDTTLYAHWSPAQTTYTINYWQQSATDNKNATDAQKTYEYAGQVTRSGLSLSNQTLTQQDINDKLPTGFKVNNTRTETSVMIKDDGSSVVNVYYDRKLITIKFAKYGGYSLPEYYYSYNWSSDADTYTGLYGTTLAANGYQWKTGAWGYLANVGNNQVGTYGMSYLGEFILPNDTVDSDVIKLFPKGNIVQTYRFFKQGLDGTYSLADTGGGAGADEFTFTEKYLGFNVKYYQRLYPDNYLFDQYASQTSAGVKVPISDEYYDRYGAYHKDYLNLVVWYERNSYKIKYLDPLDNTELPNFPVKDVLYEQNLSSYAPDTTTVQPKPSRPGYVWDGKWYKDQAQTQVFDFNTTMPPHDVKVYAGWQKVTYRVNIDPNGGRLSKTDDTYLDLHYGDRIPDYTDITRDYIQDPSGTYYYKYDSRDKDPDSTKDAYYTTDTSLSNVDTTTKYKYVKDAYKLVGWYYVNPDGSIRPYNFSGAVTQDINLRAIWRKAGDYHIIYSNDAVGTDGKPALDASGQQLQTSNEPTDPDSYDDGSHSALLRRPTMPDGYRFRGWWYNGKIYNPYDSIDIDAHLADANKNITIKPVIIPVGDIKLEDTSIKYNGNGGTRVENGNVVTQVETPRMELNSTTTIPENQYFTRTGYNLIGWHHDKDLADTGRVEFTAGQSIGIDNNPDATNTLYAVWQPKEYTVRVSKTVVGLDEDKTKDFLFNPSETLQQENFPLRDGQTKEFKVPYGTSISIDEQAYDEFKVSESITEKNLATGEADKTYDATGLQSLTVSGDVDISFTNTRIKQKVRLQKVNVENDNNFLAGAVFDIYESDANGNKASHPMYSGLVTNDKGLLLVDANNYLSLPVGKYYLTETKAPPGYLLPKNDISVLVISTGVTFEQNGNNATPIKENLVDGSTVYTFKITNSKGTELPSTGGIGTHIYILVGLALALPSGLILYYRKKI

SEQ ID NO: 215 - protein, 478 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAKPDVKPEAKPDVKPEAKPDVKIVSLIVMLSAGLITIVLKHKKN

SEQ ID NO: 216 - protein, 370 aa, Streptococcus agalactiae
TSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPE

SEQ ID NO: 217 - protein, 411 aa, Streptococcus agalactiae
TSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKLEAKPEAKPATKKSVNTSGNLAAKKAIENKKYSKK

SEQ ID NO: 218 - protein, 436 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAK

SEQ ID NO: 219 - protein, 364 aa, Streptococcus agalactiae
TSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKK

SEQ ID NO: 220 - protein, 518 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAKPDVKPEAKPDVKPEAKPDVKEAKPDVKPEAKPEAKPEAKSEAKPEAKLEAKPEAKPATKKSVNTSGNLAAKKAIENKKYSKK

SEQ ID NO: 221 - protein, 378 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKNA

SEQ ID NO: 222 - protein, 471 aa, Streptococcus agalactiae
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKNA

SEQ ID NO: 223 - protein, 522 aa, Streptococcus agalactiae
MNNNEKKVKYFLRKTAYGLASMSAAFIVCSGIVNTPTVSADSPDTLKVEKLGKLKDVKSVHELTPISIPNELKGAKEQALSSIISHPNITNSEVDKLASDYSFRINTSNDVNDVKRLLNEFYNAVARKQLDTNSADYRSKIDNISTTGLAIALEAKEIYEANKSILPHRYKDSVGTYVNSFEERRSPGKFNIWNGQEGFNAAQKLLEDVKKLLLELQNLTKNNKPNIQVPKQAPTEAAKPALSPEALTRLTTWYNQAKDLLKDDQVKDKYVDILSVQKAVDQAYDHVEEGKFITTDQANQLANKLRDALQSLELKDKKVAKPVAKGTYDVKYVDTEGKEVAKSRHFEGEEGAAFVTSAKEVAGYKLVRTEGAVSNVFTAGAQVRTYVYEKVKPEVKPDVKPEAKPEAKPEVKPDVKPEAKPEAKPEVKSDVKPEAKPEAKPEAKPEVKPDVKPEAKPEAKPATKKSVNTSGNLVAKKAIENKKYSKKLPSTGEAASPLLAIVSLIVMLSAGLITIVLKHKKN

SEQ ID NO: 224 - protein, 1085 aa, Streptococcus agalactiae
MLKKQFGNFGEKSRKVRVKMRKSGKHWVKSVMTQIGYVILSRFSGKEKSSKVQTTSEDLSRTKTSASILTAVAALGAVVGGTTDTTSVSAEETPTATELTGNEKTLATAETVVVAPEVKTVNSDSSSHSTSESQSMSTSTLQSTSASLSASESLMDSTSASLSESSSLSEYSSLSLSSSESVSASESVQSSEAATTARVQPRAMRVVSSASDMETLPAALISGEGDVTTVQGQDVTDKLQNLDIKLSGGVQAKAGVINMDKSESMHMSLKFTIDSVNRGDTFEIKLSDNIDTNGASNYSIVEPIKSPTGEVYATGIYDSQKKSIVYSFTDFAASKNNINGILDIPLWPDDTTVQNTKEDVLFSVKIKDQEATIKETVKYDPPVRIDFAGGVSVDSRITNIDDVGKKMTYISQINVDGKSLYNYNGLYTRIYNYSKESTADLKNSTIKIYKTTSDNIVESMVQDYSSMEDVTSKFANSYPEKGWYDIYWGQFIASNETYVIVVETPFTNAVTLNTTLSDYNENNGVEHNHTYSSESGYSDVNAQERKILSELVSSSESVSSSESVSNSESISTSESVSNSESISSSESVSSSESISTSESVSTSESISSSESVSSSESVSSSESISSSESVSNSESISSSESVSNSESISSSESVSSSESISNSESISSSESVSTSESISSSESVSNSESISSSESVSSSESVSTSESISSSESVSNSESISTSESVSTSESISSSESVSSSESISSSESVSNSESISNSESVSSSESVSNSESISSSESVSNSESISTSESVSTSESISSSESVSNSESISSSESVSNSESISSSESVSNSESISSSESVSNSESISSSESVSSSESVSSSESISTSESVSNSESISSSESVSNSESISSSESVSNSESISSSESVSNSESISSSESVSSSESISSSESVSSSESVSNSESISSSESVSNSESISSSESVSSSESISSSESVSNSESILSSESVSSSESISSSESISSSESVSMSTTESLSESEVSGDSEISSSTESSSQSESMNHTEIKSDSESQHEVKHQVLPETGDNSASALGLLGAGLLLGATKSRKKKKD

SEQ ID NO: 225 - protein, 1233 aa, Streptococcus agalactiae
MDKHHSKKAILKLTLITTSILLMHSNQVNAEEQELKNQEQSPVIANVAQQPSPSVTTNTVEKTSVTAASASNTAKEMGDTSVKNDKTEDELLEELSKNLDTSNLGADLEEEYPSKPETTNNKESNVVTNASTAIAQKVPSAYEEVKPESKSSLAVLDTSKITKLQAITQRGKGNVVAIIDTGFDINHDIFRLDSPKDDKHSFKTKTEFEELKAKHNITYGKWVNDKIVFAHNYANNTETVADIAAAMKDGYGSEAKNISHGTHVAGIFVGNSKRPAINGLLLEGAAPNAQVLLMRIPDKIDSDKFGEAYAKAITDAVNLGAKTINMSIGKTADSLIALNDKVKLALKLASEKGVAVVVAAGNEGAFGMDYSKPLSTNPDYGTVNSPAISEDTLSVASYESLKTISEVVETTIEGKLVKLPIVTSKPFDKGKAYDVVYANYGAKKDFEGKDFKGKIALIERGGGLDFMTKITHATNAGVVGIVIFNDQEKRGNFLIPYRELPVGIISKVDGERIKNTSSQLTFNQSFEVVDSQGGNRMLEQSSWGVTAEGAIKPDVTASGFEIYSSTYNNQYQTMSGTSMASPHVAGLMTMLQSHLAEKYKGMNLDSKKLLELSKNILMSSATALYSEEDKAFYSPRQQGAGVVDAEKAIQAQYYITGNDGKAKINLKRMGDKFDITVTIHKLVEGVKELYYQANVATEQVNKGKFALKPQALLDTNWQKVILRDKETQVRFTIDASQFSQKLKEQMANGYFLEGFVRFKEAKDSNQELMSIPFVGFNGDFANLQALETPIYKTLSKGSFYYKPNDTTHKDQLEYNESAPFESNNYTALLTQSASWGYVDYVKNGGELELAPESPKRIILGTFENKVEDKTIHLLERDAANNPYFAISPNKDGNRDEITPQATFLRNVKDISAQVLDQNGNVIWQSKVLPSYRKNFHNNPKQSDGHYRMDALQWSGLDKDGKVVADGFYTYRLRYTPVAEGANSQESDFKVQVSTKSPNLPSRAQFDETNRTLSLAMPKESSYVPTYRLQLVLSHVVKDEEYGDETSYHYFHIDQEGKVTLPKTVKIGESEVAVDPKALTLVVEDKAGNFATVKLSDLLNKAVVSEKENAIVISNSFKYFDNLKKEPMFISKKEKVVNKNLEEIILVKPQTTVTTQSLSKEITKSGNEKVLTSTNNNSSRVAKIISPKHNGDSVNHTLPSTSDRATNGLFVGTLALLSSLLLYLKPKKTKNNSK

SEQ ID NO: 226 - protein, 690 aa, Streptococcus agalactiae
MKKKIILKSSVLGLVAGTSIMFSSVFADQVGVQVIGVNDFHGALDNTGTANMPDGKVANAGTAAQLDAYMDDAQKDFKQTNPNGESIRVQAGDMVGASPANSGLLQDEPTVKNFNAMNVEYGTLGNHEFDEGLAEYNRIVTGKAPAPDSNINNITKSYPHEAAKQEIVVANVIDKVNKQIPYNWKPYAIKNIPVNNKSVNVGFIGIVTKDIPNLVLRKNYEQYEFLDEAETIVKYAKELQAKNVKAIVVLAHVPATSKNDIAEGEAAEMMKKVNQLFPENSVDIVFAGHNHQYTNGLVGKTRIVQALSQGKAYADVRGVLDTDTQDFIETPSAKVIAVAPGKKTGSADIQAIVDQANTIVKQVTEAKIGTAEVSVMITRSVDQDNVSPVGSLITEAQLAIARKSWPDIDFAMTNNGGIRADLLIKPDGTITWGAAQAVQPFGNILQVVEITGRDLYKALNEQYDQKQNFFLQIAGLRYTYTDNKEGGEETPFKVVKAYKSNGEEINPDAKYKLVINDFLFGGGDGFASFRNAKLLGAINPDTEVFMAYITDLEKAGKKVSVPNNKPKIYVTMKMVNETITQNDGTHSIIKKLYLDRQGNIVAQEIVSDTLNQTKSKSTKINPVTTIHKKQLHQFTAINPMRNYGKPSNSTTVKSKQLPKTNSEYGQSFLMSVFGVGLIGIALNTKKKHMK

SEQ ID NO: 227 - protein, 877 aa, Streptococcus agalactiae
MKGQKIIALAGLVLSCHFALTACHTQEHKNSHHIKTKQVAKKKANKKKVSVKESHKKRKGVAGVDFPTDDGFLLTKDSKILSHTDSGIVVAHGNHSHFIFYSDLKGSKFSYLIPNANTKTNKNQAVRNFKAGAVAVNTLNDGYVFNPADIVSEDANGYVVRHGDHFHYIPKASLSQQKQVQASRAVSRLGNQSNSHYRVNSSKIAGLHYPTSNGFLFNGRGIKGTTPTGILVEHHNHLHFISFADLRKGGWGSIADRYQPQKKADSKKQSPSSKKPRTENTLPKDIKDKLAYLARELHLDISRIRVLKTLNGEIGFEYPHDDHTHVIMAKDIDLSKPIPNPHHDDEDHHKGHHHDESDHKHEEHEHTKSNKLSDEDQKKLIYLAEKLGLNPNQIEVLTSEDGSIIFKYPHDDHSHTIASKDIEIGKPIPDGHHDHSHAKDKVGMATLKQIGFDDEIIQDILHADAPTPFPSNETNPEKMRQWLATVTKINIGQRTNPFQRFGLSLMPNIEVLGIGFTPINDMTPVLQFKKLKQLWMTNTGITDYSFLDKMPLLEGLDISQNGIKDLSFLTKYKQLSLIAAANNGITSLKPLAELPNLQFLVLSHNNISDLTPLSNLTKLQELYLDHNNVKNLSALSGKKDLKVLDLSNNKSADLSTLKTTSLETLLLNETNTSNLSFLKQNPKVSNLTINNAKLASLDGIEESDEIVKVEAEGNQIKSLVLKNKQGSLKFLNVTNNQLTSLEGVNNYTSLETLSVSKNKLESLDIKTPNKTVTNLDFSHNNVPTSQLKLNEKNIPEAVAKNFPAVVEGSMVGNGSLAEKAAMASKEDKQVSDNTNHQKNTEKSAQANADSKKENPKTHDEHHDHEETDHAHVGHHHH

SEQ ID NO: 228 - DNA, 28 bp, Artificial Sequence
  Primer
caccatggaagaagcaaaaactactgac

SEQ ID NO: 229 - DNA, 27 bp, Artificial Sequence
  Primer
tcattaatcagccaagatagaaccatc

SEQ ID NO: 230 - DNA, 28 bp, Artificial Sequence
  Primer
caccatggatggttctatcttggctgat

SEQ ID NO: 231 - DNA, 27 bp, Artificial Sequence
  Primer
tcattattcaattgttgggttgttgcc

SEQ ID NO: 232 - DNA, 28 bp, Artificial Sequence
  Primer
caccatgggcaacaacccaacaattgaa

SEQ ID NO: 233 - DNA, 27 bp, Artificial Sequence
  Primer
tcattaagctttttctgcatctgttgc

SEQ ID NO: 234 - DNA, 28 bp, Artificial Sequence
  Primer
caccatgttggcaggagctaccttcctt

SEQ ID NO: 235 - DNA, 27 bp, Artificial Sequence
  Primer
tcattaagtaaccttcttattgataac

SEQ ID NO: 236 - DNA, 28 bp, Artificial Sequence
  Primer
caccatggctgagatgggaaatatcact

SEQ ID NO: 237 - DNA, 27 bp, Artificial Sequence
  Primer
tcattagtcagcaagaactttgtcacc

SEQ ID NO: 238 - DNA, 28 bp, Artificial Sequence
  Primer
caccatgggtgacaaagttcttgctgac

SEQ ID NO: 239 - DNA, 30 bp, Artificial Sequence
  Primer
tcattatacttttttacctggtttgttacc

SEQ ID NO: 240 - DNA, 36 bp, Artificial Sequence
  Primer
ctgtacttccagggcaacaaaccaggtaaaaaagta

SEQ ID NO: 241 - DNA, 39 bp, Artificial Sequence
  Primer
aattaagtcgcgttattatgcaccttgcaagcgttctgt

SEQ ID NO: 242 - DNA, 28 bp, Artificial Sequence
  Primer
caccatgacagaacgcttgcaaggtgca

SEQ ID NO: 243 - DNA, 27 bp, Artificial Sequence
  Primer
tcattaagtcacttttttgttttctat

SEQ ID NO: 244 - DNA, 34 bp, Artificial Sequence
  Primer
gtttgcgcatatggctgagatgggaaatatcact

SEQ ID NO: 245 - DNA, 34 bp, Artificial Sequence
  Primer
gtggaatctcgagagtcacttttttgttttctat

SEQ ID NO: 246 - DNA, 42 bp, Artificial Sequence
  Primer
ctgtacttccagggcgaagaagcaaaaactactgacacagtg

SEQ ID NO: 247 - DNA, 42 bp, Artificial Sequence
  Primer
aattaagtcgcgttatgtaccaataccacctgtttgtggaat

SEQ ID NO: 248 - DNA, 37 bp, Artificial Sequence
  Primer
ctgtacttccagggcaataatccgaccattgaaaatg

SEQ ID NO: 249 - DNA, 39 bp, Artificial Sequence
  Primer
aattaagtcgcgttaaatcggcgtcggatcgttactgtt

SEQ ID NO: 250 - DNA, 42 bp, Artificial Sequence
  Primer
cacgctattgtcatgcctcgaactgcatttgacggttttact

SEQ ID NO: 251 - DNA, 42 bp, Artificial Sequence
  Primer
catgacaatagcgtgcaaggtcactgtgtcagtagtttttgc

SEQ ID NO: 252 - DNA, 36 bp, Artificial Sequence
  Primer
gaagcggcggaaatcgcaggtgcttactttgctttc

SEQ ID NO: 253 - DNA, 39 bp, Artificial Sequence
  Primer
gatttccgccgcttcgcctgagccaaagtaagttttaag

SEQ ID NO: 254 - DNA, 28 bp, Artificial Sequence
  Primer
caccatggacgacgcaacaactgatact

SEQ ID NO: 255 - DNA, 30 bp, Artificial Sequence
  Primer
tcattatgaatcagccaagatagaaccgtt

SEQ ID NO: 256 - DNA, 31 bp, Artificial Sequence
  Primer
caccatgaacggttctatcttggctgattca

SEQ ID NO: 257 - DNA, 27 bp, Artificial Sequence
  Primer
tcattattcttccgttgggttattacc

SEQ ID NO: 258 - DNA, 28 bp, Artificial Sequence
  Primer
caccatgggtaataacccaacggaagaa

SEQ ID NO: 259 - DNA, 27 bp, Artificial Sequence
  Primer
tcattaagctcctgccaagcgttcagt

SEQ ID NO: 260 - DNA, 28 bp, Artificial Sequence
  Primer
caccatgactgaacgcttggcaggagct

SEQ ID NO: 261 - DNA, 30 bp, Artificial Sequence
  Primer
tcattaggttacttttttgttttgaacttg

SEQ ID NO: 262 - DNA, 460 bp, Mus musculus
atgaacttcgggctgagattgattttccttgccctcattttaaaaggtgtccagtgtgaggtgcagctggtggagtctgggggagactcagtgaagcctggagggtccctgaaactctcctgtgcaacctcaggattcactttcagtagctatggcatgtcttgggtgcgccagactccagacatgaggctggagtggatcacaatcattagtggtgatggttattacacctactatcgagacagtgtgaaggggcggttcaccgtctccagagacaatgccaggaacaccctgtatttgcaaatgaccagtctgaagtctgaggacacagccatgtattactgtgcaagcctgttgggtaactacgctatggactattggggtcaaggaacctcagtcaccgtctccttagccaaaacaacacccccatcagtctatcccctggcccctggaagcttgg

SEQ ID NO: 263 - protein, 153 aa, Mus musculus
MNFGLRLIFLALILKGVQCEVQLVESGGDSVKPGGSLKLSCATSGFTFSSYGMSWVRQTPDMRLEWITIISGDGYYTYYRDSVKGRFTVSRDNARNTLYLQMTSLKSEDTAMYYCASLLGNYAMDYWGQGTSVTVSLAKTTPPSVYPLAPGSL

SEQ ID NO: 264 - DNA, 447 bp, Mus musculus
atgaagttgcctgttaggctgttggtgctgatgttctggattcctgcttccaacagtgatgttttgatgacccaaactccactctccctgcctgtcgggcttggagatcaagtctccatctcttgcagatctggtcagagtcttgaacatagtaatggagacacctatttacaatggtacctacagaaacctggccagtctccaaagctcctgatctacaaagtttccaaccgattttctggggtcccagacaggttcagtggcagtggatcagggacagatttcacactcaagatcagcagagtggaggctgaggatctgggagtttattactgctttcagggttcacatgttcctcccacgttcggaggggggaccaagctggaaataaaacgggctgatgctgcaccaactgtatccatcttcccaccatccagtaagcttggg

SEQ ID NO: 265 - protein, 149 aa, Mus musculus
MKLPVRLLVLMFWIPASNSDVLMTQTPLSLPVGLGDQVSISCRSGQSLEHSNGDTYLQWYLQKPGQSPKLLIYKVSNRFSGVPDRFSGSGSGTDFTLKISRVEAEDLGVYYCFQGSHVPPTFGGGTKLEIKRADAAPTVSIFPPSSKLG

SEQ ID NO: 266 - DNA, 460 bp, Mus musculus
atgaacttcgggctgagattgattttccttgtccttattttaaaaggtgtccagtgtgaagtgcagctggtggagtctgggggaggcttagtgaagcctggagggtccctgaaactctcctgtgcagcctctggattcactttcagtagctatgccatgtcttgggttcgcctgtctccagagacgaggctggagtgggtcgcagaaattagtggtgatggcagttacacctactatccagaccctgtgacgggccgattcaccatctccagagacaatgccaggaacaccctgtacctggaaatgagcagtctgaggtctgaagacacggccatgtattactgtggaagtctgattgggaactatgctatggactactggggtcaaggaacctcagtcaccgtctcctcagccaaaacaacagccccatcggtctatcccctggcccctggaagcttgg

SEQ ID NO: 267 - protein, 153 aa, Mus musculus
MNFGLRLIFLVLILKGVQCEVQLVESGGGLVKPGGSLKLSCAASGFTFSSYAMSWVRLSPETRLEWVAEISGDGSYTYYPDPVTGRFTISRDNARNTLYLEMSSLRSEDTAMYYCGSLIGNYAMDYWGQGTSVTVSSAKTTAPSVYPLAPGSL

SEQ ID NO: 268 - DNA, 456 bp, Mus musculus
tactagtcgacatgaagttgcctgttaggctgttggtgctgatgttctggattcctgcttccagcagtgatgttttgatgacccaaactccactctccctgcctgtcagtcttggagatcaagcctccatctcttgtagatctagtcagagcattgtacatagtaatggagacacctatttagaatggtacctgcagaaaccaggccagtctccaaagctccttatctacaaagtttccaaccgattttctggggtcccagacaggttcagtggcagtggatcagggacagatttcacactcaagatcagcagagtggaggctgaggatctgggagtttattactgctttcaaggttcacatgttccccggacgttcggtggaggcaccaagctggaaatcaaacgggctgatgctgcaccaactgtatccatcttcccaccatccagtaagcttg

SEQ ID NO: 269 - protein, 151 aa, Mus musculus
LVDMKLPVRLLVLMFWIPASSSDVLMTQTPLSLPVSLGDQASISCRSSQSIVHSNGDTYLEWYLQKPGQSPKLLIYKVSNRFSGVPDRFSGSGSGTDFTLKISRVEAEDLGVYYCFQGSHVPRTFGGGTKLEIKRADAAPTVSIFPPSSKL

SEQ ID NO: 270 - protein, 26 aa, Streptococcus agalactiae
TYRVIERVSGYAPEYVSFVNGVVTIK

SEQ ID NO: 271 - protein, 665 aa, Streptococcus pneumoniae
MKSINKFLTMLAALLLTASSLFSAATVFAAGTTTTSVTVHKLLATDGDMDKIANELETGNYAGNKVGVLPANAKEIAGVMFVWTNTNNEIIDENGQTLGVNIDPQTFKLSGAMPATAMKKLTEAEGAKFNTANLPAAKYKIYEIHSLSTYVGEDGATLTGSKAVPIEIELPLNDVVDAHVYPKNTEAKPKIDKDFKGKANPDTPRVDKDTPVNHQVGDVVEYEIVTKIPALANYATANWSDRMTEGLAFNKGTVKVTVDDVALEAGDYALTEVATGFDLKLTDAGLAKVNDQNAEKTVKITYSATLNDKAIVEVPESNDVTFNYGNNPDHGNTPKPNKPNENGDLTLTKTWVDATGAPIPAGAEATFDLVNAQTGKVVQTVTLTTDKNTVTVNGLDKNTEYKFVERSIKGYSADYQEITTAGEIAVKNWKDENPKPLDPTEPKVVTYGKKFVKVNDKDNRLAGAEFVIANADNAGQYLARKADKVSQEEKQLVVTTKDALDRAVAAYNALTAQQQTQQEKEKVDKAQAAYNAAVIAANNAFEWVADKDNENVVKLVSDAQGRFEITGLLAGTYYLEETKQPAGYALLTSRQKFEVTATSYSATGQGIEYTAGSGKDDATKVVNKKITIPQTGGIGTIIFAVAGAAIMGIAVYAYVKNNKDEDQLA

SEQ ID NO: 272 - protein, 5 aa, Artificial Sequence
  VARIANT (3)...(3): Xaa = Any Amino Acid; LPXTG anchor
LPXTG

SEQ ID NO: 273 - protein, 5 aa, Artificial Sequence
  IPMTG anchor
IPMTG

The invention claimed is:

1. A polypeptide comprising an amino acid sequence having at least 90% sequence identity to a sequence selected from the group consisting of SEQ ID NOs: 83, 84, 85, 86 and 87.

2. The polypeptide of claim 1, which comprises the amino acid sequence SEQ ID NO:83.

3. The polypeptide of claim 1, which comprises the amino acid sequence SEQ ID NO:84.

4. The polypeptide of claim 1, which comprises the amino acid sequence SEQ ID NO:85.

5. The polypeptide of claim 1, which comprises the amino acid sequence SEQ ID NO:86.

6. The polypeptide of claim 1, which comprises the amino acid sequence SEQ ID NO:87.

7. The polypeptide of claim 1, wherein the amino acid sequence has at least 95% sequence identity.

8. The polypeptide of claim 1, wherein the amino acid sequence has at least 96% sequence identity.

9. The polypeptide of claim 1, wherein the amino acid sequence has at least 97% sequence identity.

10. The polypeptide of claim 1, wherein the amino acid sequence has at least 98% sequence identity.

11. The polypeptide of claim 1, wherein the amino acid sequence has at least 99% sequence identity.

* * * * *